US007364878B2

(12) United States Patent
Otte et al.

(10) Patent No.: US 7,364,878 B2
(45) Date of Patent: *Apr. 29, 2008

(54) METHOD FOR SIMULTANEOUS PRODUCTION OF MULTIPLE PROTEINS; VECTORS AND CELLS FOR USE THEREIN

(75) Inventors: Arie Pieter Otte, Amersfoort (NL); Arthur Leo Kruckeberg, Shoreline, WA (US); Richard George Antonius Bernardus Sewalt, Arnhem (NL)

(73) Assignee: Chromagenics B.V., Leiden (NL)

( * ) Notice: Subject to any disclaimer, the term of this patent is extended or adjusted under 35 U.S.C. 154(b) by 414 days.

This patent is subject to a terminal disclaimer.

(21) Appl. No.: 11/013,031

(22) Filed: Dec. 14, 2004

(65) Prior Publication Data

US 2005/0191723 A1     Sep. 1, 2005

Related U.S. Application Data

(63) Continuation of application No. PCT/NL03/00432, filed on Jun. 13, 2003.

(30) Foreign Application Priority Data

Jun. 14, 2002   (EP)   ................................. 02077350

(51) Int. Cl.
  *C12P 21/02*   (2006.01)
(52) U.S. Cl. .................. 435/69.1; 435/320.1; 435/326; 435/358
(58) Field of Classification Search ...................... None
See application file for complete search history.

(56) References Cited

U.S. PATENT DOCUMENTS

| 5,610,053 | A | 3/1997 | Chung et al. |
| 5,773,695 | A | 6/1998 | Thompson et al. |
| 5,888,809 | A | 3/1999 | Allison |
| 6,395,549 | B1 | 5/2002 | Tuan et al. |
| 6,521,419 | B1 | 2/2003 | Koduri et al. |
| 6,586,205 | B1 | 7/2003 | Glucksmann et al. |
| 6,872,524 | B1 | 3/2005 | Otte |
| 2003/0138908 | A1 | 7/2003 | Koduri et al. |
| 2003/0166042 | A1 | 9/2003 | Glucksmann et al. |
| 2003/0199468 | A1 | 10/2003 | Otte et al. |
| 2005/0106609 | A1 | 5/2005 | Otte |
| 2005/0214906 | A1* | 9/2005 | Otte et al. .................. 435/69.1 |

FOREIGN PATENT DOCUMENTS

| EP | 1 273 666 | 1/2003 |
| WO | WO 96/04390 | 2/1996 |
| WO | WO 97/27207 | 7/1997 |
| WO | WO 98/11207 | 3/1998 |
| WO | WO 98/49289 | 11/1998 |
| WO | WO 00/05393 | 2/2000 |
| WO | WO 00/09749 | 2/2000 |
| WO | WO 00/17337 | 3/2000 |
| WO | WO 00/23606 | 4/2000 |
| WO | WO 01/59117 | 8/2001 |
| WO | WO 01/59118 | 8/2001 |
| WO | WO 02/24930 A2 | 3/2002 |
| WO | WO 03/004704 | 1/2003 |
| WO | WO 2004/055215 A1 | 7/2004 |
| WO | WO 2004/056986 A2 | 7/2004 |

OTHER PUBLICATIONS

Bell et al., Insulators and Boundaries: Versatile Regulatory Elements in the Eukaryotic Genome, Science, pp. 447-450, vol. 291, No. 5503, 2001.
Chung et al., A 5' Element of the Chicken Beta-Globin Domain Serves as an Insulator in Human Erythroid Cells and Protects against Position Effect in Drosophila, Aug. 13, 1993, Cell, pp. 505-514, vol. 74.
Database EMBL 'Online!, Jul. 8, 1992, *H. sapiens* HOX4B gene upstream sequence XP002348163 retrieved from EBI, Database accession No. X67079, Abstract, 1992.
Kellum et al., A Group of scs Elements Function as Domain Boundaries in an Enhancer-Blocking Assay, Molecular and Cellular Biology, May 1992, pp. 2424-2431, vol.12, No. 5.
Partial European Search Report, EP 05 07 6209, dated Oct. 7, 2005.
European Search Report dated Dec. 22, 2005.
Database EMBL 'Online! Aug. 4, 1999, "*Homo sapiens* chromosome 19 clone CTD-2540B15, complete sequence," XP002359985 retrieved from EBI accession No. EM_PRO:AC008738, database accession No. AC008738 for SEQ ID No. 7.
Database EMBL 'Online! Feb. 3, 2004, "Sequence 33099 from Patent W002068579," XP002359986 retrieved from EBI accession No. EM_PRO:CQ747165, database accession No. CQ747165 for SEQ ID No. 9.
Database EMBL 'Online! Sep. 24, 2000, "*Homo sapiens* chromosome 4 clone RP11-680118, working draft sequence, 25 unordered pieces," XP002359987 retrieved from EBI accession No. EM_PRO:AC080087, database accession No. AC080087 for SEQ ID No. 9.
Database EMBL 'Online! Dec. 15, 1999, "*Homo sapiens* BAC clone RP11-572N21 from 2, complete sequence," XP002359988 retrieved from EBI accession No. EM_PRO:AC018470, database accession No. AC018470, for SEQ ID No. 17.

(Continued)

Primary Examiner—James S Ketter
(74) Attorney, Agent, or Firm—TraskBritt

(57) ABSTRACT

The invention relates to the field of biochemistry, molecular biology, pharmacology and diagnosis. More specifically the present invention relates to the production of proteins in a host cell. Even more specifically, the invention relates to a method for improving expression of two or more proteins in a (host) cell. The method is suited for production of, for example, recombinant antibodies that can be used in a pharmaceutical preparation or as a diagnostic tool. In one embodiment, the invention provides a method for obtaining a cell which expresses two or more proteins comprising providing the cell with two or more protein expression units encoding two or more proteins, characterized in that at least two of the protein expression units comprise at least one STAR sequence.

55 Claims, 25 Drawing Sheets

OTHER PUBLICATIONS

Database EMBL 'Online! Dec. 23, 1999, "Human DNA sequence from clone RP11-54H19 on chromosome 1 Contains the 3' end of the LMNA gene for lamin A/C, the gene for a novel protein similar to semaphorins (FLJ12287), a novel gene (KIAA0446), the PMFI gene for polyamine-modulated factor 1, the BGLAP gene for bone gamma-carboxyglutamate (gla) p," XP002359989, retrived from EBI accession No. EM_PRO:AL135927, database accession No. AL135927 for SEQ ID No. 27.

Database EMBL 'Online! Apr. 26, 2001, "RST28606 Athersys RAGE Library *Homo sapiens* cDNA, mRNA sequence," XP002359990 retrieved from EBI accession No. EM_PRO:BG209092, database accession No. BG209092 for SEQ ID No. 40.

Database EMBL 'Online! Sep. 29, 1999, "*Homo sapiens* genomic DNA, chromosome 22q11.2, Cat Eye Syndrome region, clone:N64E9," XP002359991, retrieved from EBI accession No. EM_PRO:AP000526, database accession No. AP000526 for SEQ ID No. 40.

Database EMBL 'Online! Oct. 28, 1998, "*Homo sapiens* neurexin III-alpha gene, partial eds," XP002359992, retrieved from EBI accession No. EM_PRO:AF099810, database accession No. AF099810 for SEQ ID No. 43.

Database EMBL 'Online! Jan. 25, 2001, "QV2-NN0045-081200-535-c10 NN0045 *Homo sapiens* cDNA, mRNA sequence." XP002359993 retrieved from EBI accession No. EM_PRO:BF960930, database accession No. BF960930 for SEQ ID No. 43.

Database EMBL 'Online! Sep. 29, 1999, *Homo sapiens* genomic DNA, chromosome 22q11.2, Cat Eye Syndrome region, clone:N14H11, XP002359994 retrieved from EBI accession No. EM_PRO:AP000525, database accession No. AP000525 for SEQ ID No. 44.

Database EMBL 'Online! Mar. 19, 1998, CIT-HSP-2172C8.TF CIT-HSP *Homo sapiens* genomic clone 2172C8, genomic survey sequence, XP002359995 retrieved from EBI accession No. EM_PRO:B92131, database accession No. B92131 for SEQ ID No. 44.

Database EMBL 'Online ! Sep. 29, 1999, "*Homo sapiens* genomic DNA, chromosome 22q11.2, Cat Eye Syndrome region, clone:c91G6," XP002359996 retrieved from EBI accession No. EM_PRO:AP000528, database accession No. AP000528 for SEQ ID No. 45.

Database EMBL 'Online ! Mar. 15, 1999, "*Homo sapiens* chromosome UNK clone CTA-435J10, working draft sequence, 1 unordered pieces," XP002359997 retrieved from EBI accession No. EM_PRO:AC007044, database accession No. AC007044 for SEQ ID No. 61.

Emery et al., "A chromatin insulator protects retrovirus vectors from chromosomal position effects,"0 Proceedings of the National Academy of Sciences of USA, Aug. 1, 2000, pp. 9150-9155, vol. 97, No. 16.

West et al., "Insulators: many functions, many mechanisms," Genes and Development, Feb. 1, 2002, pp. 271-288, vol. 16 No. 3.

Kwaks et al., "Indentification of anti-repressor elements that confer high stable protein in production in mammalian cells," Nature Biotechnology, May 20, 2003, pp. 553-558, vol. 21, No. 5.

Pile et al., "GAGA Factor-dependent Transcription and Establishment of DNase Hypersensitivity Are Independent and Unrelated Events In Vivo," J. of Biological Chemistry, Jan. 14, 2000, pp. 1398-1404, vol. 275, No. 2.

Sigrist et al., "Chromatin Insulator Elements Black the Silencing of a Target Gene by the Drosophila Polycomb Response Element (PRE) but Allow trans Interactions Between PREs on Different Chromosomes," Genetics, Sep. 1997, pp. 209-211, vol. 147, No. 1.

PCT International Search Report, PCT/NL03/00850, dated Sep. 6, 2004.

PCT International Preliminary Examination Report, PCT/NL03/00850, dated Mar. 24, 2005.

Van Der Vlag et al., Transcription Repression Mediated by Polycomb Group Proteins and Other Chromatin-associated Repressors Is Selectively Blocked by Insulators, Journal of biological Chemistry, Jan. 7, 2000, pp. 697-704, vol. 275, No. 1.

Aranda et al., Definition of Transcriptional Pause Elements in Fission Yeast, Molecular and Cellular Biology, Feb. 1999, pp. 1251-1261, vol. 19, No. 2.

Maniatis et al., Recognition Sequences of Repressor and Polymerase in the Operators of Bacteriophage Lambda, Cell, Jun. 1975, pp. 109-113, Vol. 5.

Reik et al., Biotechnologies and therapeutics: Chromatin as a target, Current Opinion in Genetics & Development, 2002, pp. 233-242, vol. 12.

Eggermont et al., Poly(A) signals and transcriptional pause sites combine to prevent interference between RNA polymerase II promoters, The EMBO Journal, 1993, pp. 2539-2548, vol. 12, No. 6.

Johnson et al., Requirements for utilization of CREB binding protein by hypersensitive site two of the Beta-globin locus control region, Nucleic Acids Research 2002, pp. 1522-1530, vol. 30, No. 7.

Martinez-Balbas et al., The acetyltransferase activity of CBP stimulates transcription, The EMBO Journal, 1998, pp. 2886-2893, vol. 17, No. 10.

Seum et al., A GAL4-HPl fusion protein targeted near heterochromatin promotes gene silencing, Chromosoma, 2000, pp. 453-459, vol. 109.

Farrell et al., Conserved CTCF Insulator Elements Flank the Mouse and Human Beta-Globin Loci, Molecular and Cellular Biology, Jun. 2002, pp. 3820-3831, vol. 22, No. 11.

Chan et al., p300-CBP proteins: HATs for transcriptional bridges and scaffolds, Journal of Cell Science, 2001, pp. 2363-2373, vol. 114.

Burgess-Beusse et al., The insulation of genes from external enhancers and silencing chromatin, PNAS, Dec. 10, 2002, pp. 16433-16437, vol. 99, Suppl. 4.

Glucksmann et al., Database accession No. AAH76193, Oct. 29, 2001.

Migliaccio et al., "Stable and unstable transgene integration sites in the human genome: extinction of the Green Fluorescent Protein transgene in K562 cells," Gene, Oct. 3, 2000, pp. 197-214, vol. 256, No. 1-2.

Mielke et al., "Stabilized, long-term expression of heterodimeric proteins from tricistronic mRNA," Gene, Aug. 22, 2000, pp. 1-8, vol. 254, No. 1-2.

Auten et al., "Effect of Scaffold Attachment Region on Transgene Expression in Retrovirus Vector-Transduced Primary T cells and Macrophages," Human Gene Therapy, May 20, 1999, pp. 1389-1399, vol. 10, No. 8.

Han et al., "Matrix attachment regions (MARs) enhance transformation frequency and transgene expression in poplar," Transgenic Research, 1997, pp. 415-420, vol. 6.

PCT International Search Report, PCT/NL2003/00432, dated Jan. 9, 2004.

* cited by examiner

FIG 1
Schematic diagram of the invention
FIG 1A
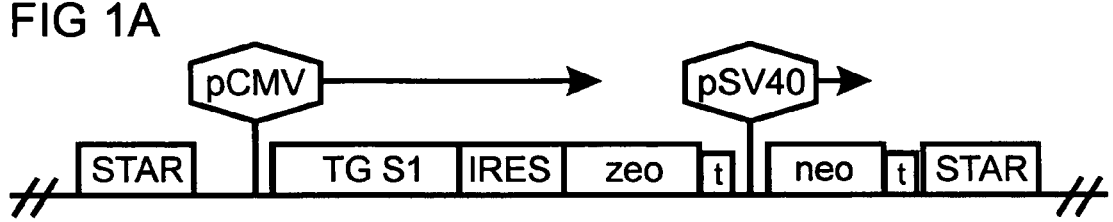
FIG 1B
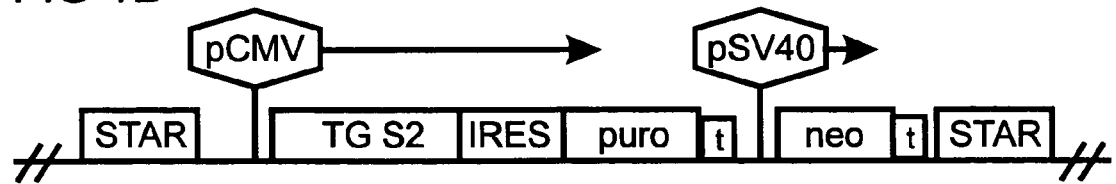

Vector for testing STAR activity

Vector for testing STAR activity with IRES and SEAP

Vector for testing STAR activity
with IRES and GFP

FIG 4
Comparison of one-step and two-step selection
A. One-step selection
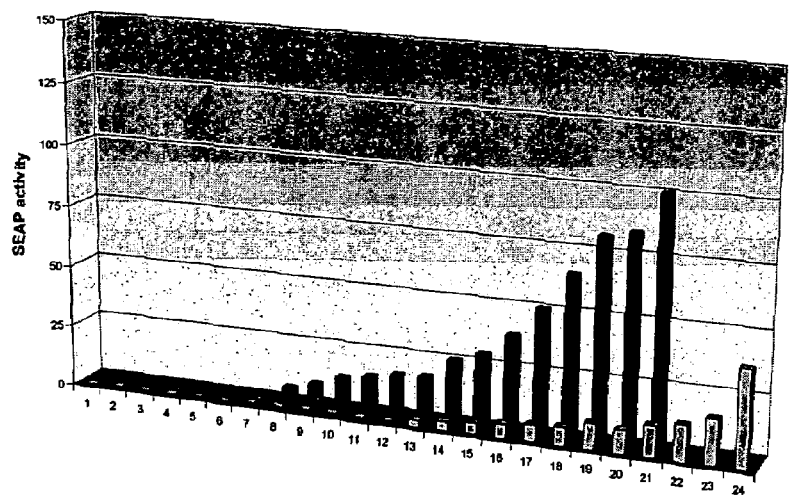
B. Two-step selection
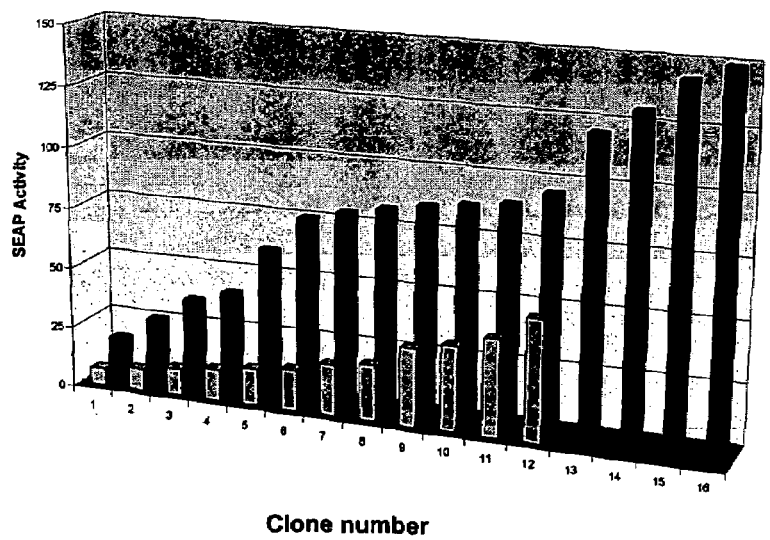
Clone number
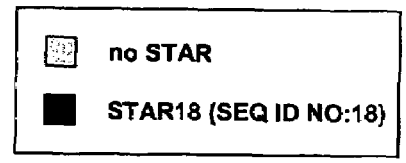

FIG 5
The PP family of plasmids
A
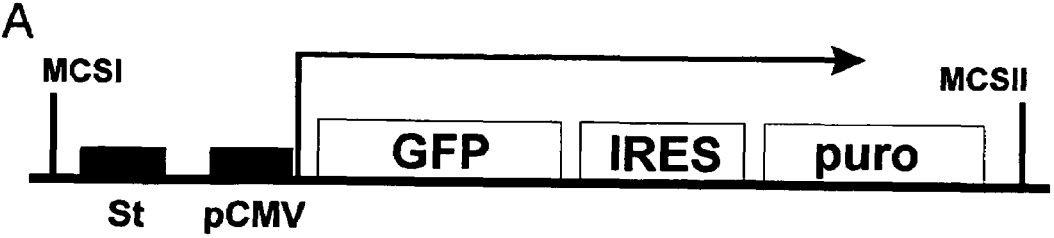
B
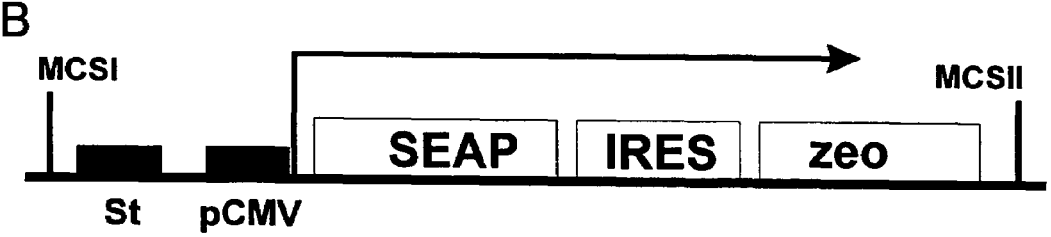
C
D
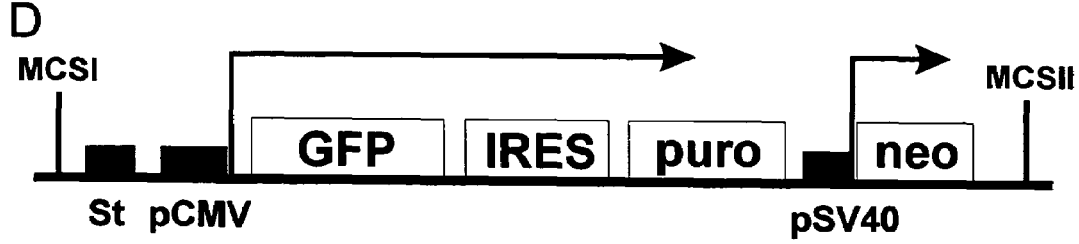
E
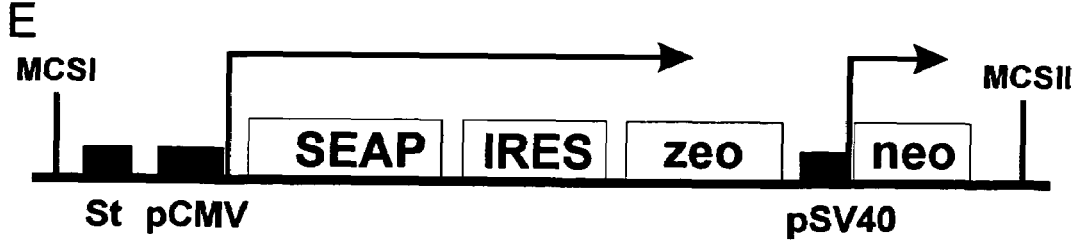

Vector for testing STAR activity

STAR finemapping
(SEQ ID NOS:10 and 27)

FIG 12
STAR element orientation
A. pSelect vector with cloned STAR element:
B. pSDH vector, STARs in native orientation:
C. pSDH vector, STARs in opposite orientation:

STAR copy number dependency

Enhancer assay

Classification of STARs by Discriminant Analysis with Oligo and Dyad Models

FIG 23
The effect of STAR7 (SEQ ID NO:7) on simultaneous GFP and RED expression
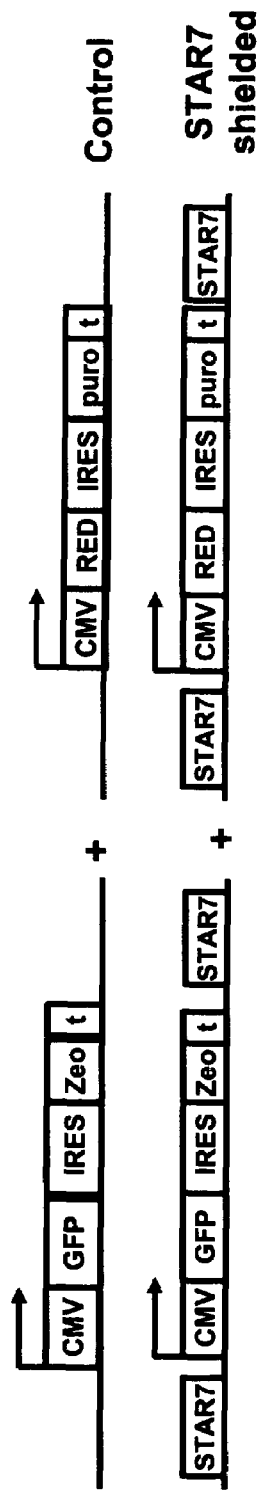
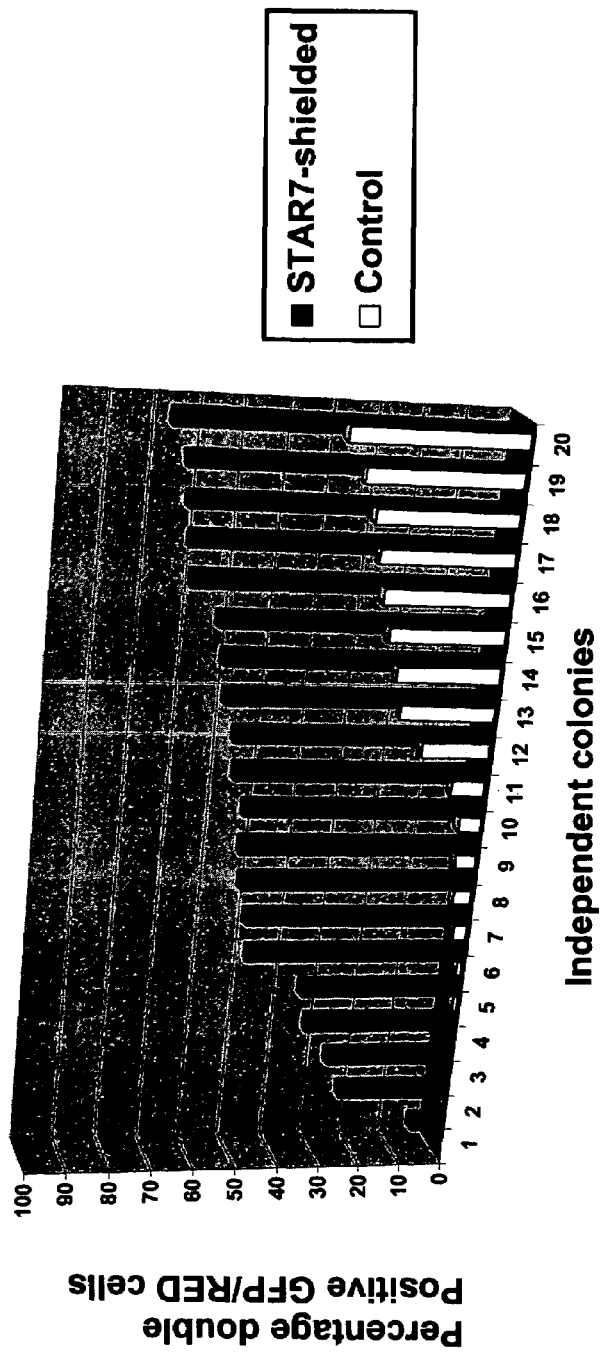

The effect of STAR7 (SEQ ID NO:7) on simultaneous expression of light and heavy chain antibody chains in CHO cells

METHOD FOR SIMULTANEOUS PRODUCTION OF MULTIPLE PROTEINS; VECTORS AND CELLS FOR USE THEREIN

CROSS-REFERENCE TO RELATED APPLICATIONS

This is a continuation application under 35 U.S.C. § 119 of International Patent Application No. PCT/NL03/00432, filed Jun. 13, 2003, published in English as International Patent Publication No. WO 03/106684 on Dec. 24, 2003, which claims the benefit, under 35 U.S.C. § 119, of European Patent Application No. EP 02077350 filed Jun. 14, 2002, the entirety of both are hereby incorporated by reference.

STATEMENT ACCORDING TO 37 C.F.R. § 1.52(e)(5)-SEQUENCE LISTING SUBMITTED ON COMPACT DISC

Pursuant to 37 C.F.R. § 1.52(e)(1)(iii), a compact disc containing an electronic version of the Sequence Listing has been submitted concomitant with this application, the contents of which are hereby incorporated by reference. A second compact disk is submitted and is an identical copy of the first compact disc. The discs are labeled, "copy 1" and "copy 2," respectively, and each disc contains one file entitled "P60556PC00.txt" which is 502 KB, and created on Nov. 29, 2004.

TECHNICAL FIELD

The invention relates to the fields of biochemistry, molecular biology, pharmacology and diagnosis. More specifically, the present invention relates to the production of proteins in a host cell. Even more specifically, the invention relates to a method for improving expression of two or more proteins in a (host) cell. The method is suited for production of, for example, recombinant antibodies that can be used in a pharmaceutical preparation or as a diagnostic tool.

BACKGROUND OF THE INVENTION

Proteins are produced in systems for a wide range of applications in biology and biotechnology. These include research into cellular and molecular function, production of proteins as biopharmaceuticals or diagnostic reagents, and modification of the traits or phenotypes of livestock and crops. Biopharmaceuticals are usually proteins that have an extracellular function, such as antibodies for immunotherapy or hormones or cytokines for eliciting a cellular response. Proteins with extracellular functions exit the cell via the secretory pathway, and undergo post-translational modifications during secretion. The modifications (primarily glycosylation and disulfide bond formation) do not occur in bacteria. Moreover, the specific oligosaccharides attached to proteins by glycosylating enzymes are species and cell-type specific. These considerations often limit the choice of host cells for heterologous protein production to eukaryotic cells (Kaufman, 2000). For expression of human therapeutic proteins, host cells such as bacteria, yeast, or plants may be inappropriate. Even the subtle differences in protein glycosylation between rodents and human, for example, can be sufficient to render proteins produced in rodent cells unacceptable for therapeutic use (Sheeley et al., 1997). The consequences of improper (i.e., non-human) glycosylation include immunogenicity, reduced functional half-life, and loss of activity. This limits the choice of host cells further, to human cell lines or to cell lines such as Chinese Hamster Ovary (CHO) cells, which may produce glycoproteins with human-like carbohydrate structures (Liu, 1992).

Some proteins of biotechnological interest are functional as multimers, i.e., they consist of two or more, possibly different, polypeptide chains in their biologically and/or biotechnologically active form. Examples include antibodies (Wright & Morrison, 1997), bone morphogenetic proteins (Groeneveld & Burger, 2000), nuclear hormone receptors (Aranda & Pascual, 2001), heterodimeric cell surface receptors (e.g., T cell receptors, (Chan & Mak, 1989)), integrins (Hynes, 1999), and the glycoprotein hormone family (chorionic gonadotrophin, pituitary luteinizing hormone, follicle-stimulating hormone, and thyroid-stimulating hormone, (Thotakura & Blithe, 1995)). Production of such multimeric proteins in heterologous systems is technically difficult due to a number of limitations of current expression systems. These limitations include (1) difficulties in isolating recombinant cells/cell lines that produce the monomer polypeptides at high levels (predictability and yield), (2) difficulties in attaining production of the monomeric polypeptides in stoichiometrically balanced proportions (Kaufman, 2000), and (3) declines in the levels of expression during the industrial production cycle of the proteins (stability). These problems are described in more detail below.

(1) Recombinant proteins such as antibodies that are used as therapeutic compounds need to be produced in large quantities. The host cells used for recombinant protein production must be compatible with the scale of the industrial processes that are employed. Specifically, the transgene (or the gene encoding a protein of interest, the two terms are used interchangeably herein) expression system used for the heterologous protein needs to be retained by the host cells in a stable and active form during the growth phases of scale-up and production. This is achieved by integration of the transgene into the genome of the host cell. However, creation of recombinant cell lines by conventional means is a costly and inefficient process due to the unpredictability of transgene expression among the recombinant host cells. The unpredictability stems from the high likelihood that the transgene will become inactive due to gene silencing (McBurney et al., 2002). Using conventional technologies, the proportion of recombinant host cells that produce one polypeptide at high levels ranges from 1-2%. In order to construct a cell line that produces two polypeptides at high levels, the two transgenes are generally integrated independently. If the two transgenes are transfected simultaneously on two separate plasmids, the proportion of cells that will produce both polypeptides at high levels will be the arithmetic product of the proportions for single transgenes. Therefore, the proportion of such recombinant cell lines ranges from one in 2,500 to one in 10,000. For multimeric proteins with three or more subunits, the proportions decline further. These high-producing cell lines must subsequently be identified and isolated from the rest of the population. The methods required to screen for these rare high-expressing cell lines are time-consuming and expensive.

An alternative to simultaneous transfection of two transgene-bearing plasmids is sequential transfection. In this case the proportion of high-yielding clones will be the sum of the proportions for single transgenes, i.e., 2-4%. Sequential transfection however has (major) drawbacks, including high costs and poor stability. The high costs result from various factors: in particular, the time and resources required for screening for high-expressing cell lines is doubled, since high expression of each subunit must be screened for separately. The poor overall stability of host cells expressing two polypeptides is a consequence of the inherent instability of each of the two transgenes.

(2) Production of multimeric proteins requires balanced levels of transcriptional and translational expression of each of the polypeptide monomers. Imbalanced expression of the monomers is wasteful of the costly resources used in cell cultivation. Moreover, the imbalanced expression of one monomer can have deleterious effects on the cell. These effects include (a) sequestration of cellular factors required for secretion of the recombinant proteins (e.g., chaperones in the endoplasmic reticulum, (Chevet et al., 2001)), and (b) induction of stress responses that result in reduced rates of growth and protein translation, or even in apoptosis (programmed cell death) (Pahl & Baeuerle, 1997, Patil & Walter, 2001). These deleterious effects lead to losses in productivity and yield and to higher overhead costs.

(3) Silencing of transgene expression during prolonged host cell cultivation is a commonly observed phenomenon. In vertebrate cells it can be caused by formation of heterochromatin at the transgene locus, which prevents transcription of the transgene. Transgene silencing is stochastic; it can occur shortly after integration of the transgene into the genome, or only after a number of cell divisions. This results in heterogeneous cell populations after prolonged cultivation, in which some cells continue to express high levels of recombinant protein while others express low or undetectable levels of the protein (Martin & Whitelaw, 1996, McBurney et al., 2002). A cell line that is used for heterologous protein production is derived from a single cell, yet is often scaled up to, and maintained for long periods at, cell densities in excess of ten million cells per milliliter in cultivators of 1,000 liters or more. These large cell populations ($10^{14}$-$10^{16}$ cells) are prone to serious declines in productivity due to transgene silencing (Migliaccio et al., 2000, Strutzenberger et al., 1999).

The instability of expression of recombinant host cells is particularly severe when transgene copy numbers are amplified in an attempt to increase yields. Transgene amplification is achieved by including a selectable marker gene such as dihydrofolate reductase (DHFR) with the transgene during integration. Increased concentrations of the selection agent (in the case of DHFR, the drug methotrexate) select for cells that have amplified the number of DHFR genes in the chromosome. Since the transgene and DHFR are co-localized in the chromosome, the transgene copy number increases too. This is correlated with an increase in the yield of the heterologous protein (Kaufman, 1990). However, the tandem repeats of transgenes that result from amplification are highly susceptible to silencing (Garrick et al., 1998, Kaufman, 1990, McBurney et al., 2002). Silencing is often due to a decline in transgene copy number after the selection agent is removed (Kaufman, 1990). Removal of the selection agent, however, is routine during industrial biopharmaceutical production, for two reasons. First, cultivation of cells at industrial scales in the presence of selection agents is not economically feasible, as the agents are expensive compounds. Second, and more importantly, concerns for product purity and safety preclude maintaining selection during a production cycle. Purifying a recombinant protein and removing all traces of the selection agent is necessary if the protein is intended for pharmaceutical use. However, it is technically difficult and prohibitively expensive to do so, and demonstrating that this has been achieved is also difficult and expensive. Therefore, amplification-based transgenic systems that require continual presence of selection agents are disadvantageous.

Alternatively, silencing can be due to epigenetic effects on the transgene tandem repeats, a phenomenon known as Repeat Induced Gene Silencing (RIGS) (Whitelaw et al., 2001). In these cases the copy number of the transgene is stable, and silencing occurs due to changes in the chromatin structure of the transgenes (McBurney et al., 2002). The presence of a selection agent during cell cultivation may be unable to prevent silencing of the transgene transcription unit because transgene expression is independent of expression of the selectable marker. The lack of a means to prevent RIGS in conventional transgenic systems thus results in costly losses in productivity.

SUMMARY OF THE INVENTION

The problems associated with conventional transgene expression technologies for protein production and more specifically for multimeric protein production clearly demonstrate a need in the art for a system that overcomes these problems. The present invention relates to a novel system for creating (host) cells/cell lines that efficiently express two or more proteins, for example, two or more polypeptide monomers and optionally produce functional multimeric proteins from them. Important examples of heterologous multimer proteins are recombinant antibodies. In one embodiment, the invention takes advantage of proprietary DNA elements that protect transgenes from silencing, termed STabilizing Anti-Repressor (STAR or STAR™; these terms will be used interchangeably herein) elements, for the production of two or more proteins.

The invention also discloses a novel configuration of transcriptional and translational elements and selectable marker genes. In one embodiment, the invention uses antibiotic resistance genes and protein translation initiation sites with reduced translation efficiency (for example, an Internal Ribosome Entry Site, IRES) in novel ways that improve heterologous protein expression. The combination of the STAR elements and these other elements results in a system for obtaining a cell which expresses two or more proteins that (1) predictably produces a high proportion of recombinant cell lines with high yields of heterologous proteins, (2) exhibits balanced and proportional expression of two or more polypeptide monomers which are constituents of a multimeric protein, and (3) creates recombinant cell lines with stable productivity characteristics.

Therefore, the invention provides in one embodiment, a method for obtaining a cell which expresses two or more proteins comprising providing the cell with two or more protein expression units encoding the two or more proteins, characterized in that at least two of the protein expression units comprise at least one STAR sequence.

STAR-sequences can be identified (as disclosed, for example, in Example 1 of EP 01202581.3) using a method of detecting, and optionally selecting, a DNA sequence with a gene transcription-modulating quality, comprising providing a transcription system with a variety of fragment-comprising vectors, the vectors comprising i) an element with a gene-transcription repressing quality, and ii) a promoter directing transcription of a reporter gene, the method further comprising performing a selection step in the transcription system in order to identify the DNA sequence with the gene transcription modulating quality. Preferably, the fragments are located between i) the element with a gene-transcription repressing quality, and ii) the promoter directing transcription of the reporter gene. RNA polymerase initiates the transcription process after binding to a specific sequence, called the promoter, that signals where RNA synthesis should begin. A modulating quality can enhance transcription from the promoter in cis, in a given cell type and/or a given promoter. The same DNA sequence can comprise an enhancing quality in one type of cell or with one type of promoter, whereas it can comprise another or no gene transcription modulating quality in another cell or with another type of promoter. Transcription can be influenced through a direct effect of the regulatory element (or the protein(s) binding to it) on the transcription of a particular promoter. Transcription can however, also be influenced by an indirect effect, for instance because the regulatory element affects the function of one or more other regulatory elements. A gene transcription modulating quality can also comprise a stable gene transcription quality. With stable is meant that the observed transcription level is not significantly changed over at least 30 cell divisions. A stable quality is useful in situations wherein expression characteristics should be predictable over many cell divisions. Typical examples are cell lines transfected with foreign genes. Other examples are transgenic animals and plants and gene therapies. Very often, introduced expression cassettes function differently after increasing numbers of cell divisions or plant or animal generations. Preferably, a stable quality comprises a capacity to maintain gene transcription in subsequent generations of a transgenic plant or animal. Of course, if expression is inducible, this quality comprises the quality to maintain inducibility of expression in subsequent generations of a transgenic plant or animal. Frequently, expression levels drop dramatically with increasing numbers of cell divisions. With the herein described method for identification of a DNA sequence with a gene transcription modulating quality, it is possible to detect and optionally select a DNA sequence that is capable of at least in part preventing the dramatic drop in transcription levels with increasing numbers of cell divisions. Preferably, the gene transcription modulating quality comprises a stable gene transcription quality. Strikingly, fragments comprising a DNA sequence with the stable gene transcription quality can be detected and optionally selected with the method for identification of a DNA sequence with a gene transcription modulating quality, in spite of the fact that this method does not necessarily measure long term stability of transcription. Preferably, this gene transcription modulating quality comprises a stable gene transcription enhancing quality. It has been observed that incorporation of a DNA sequence with a gene transcription modulating quality in an expression vector with a gene of interest, results in a higher level of transcription of the gene of interest, upon integration of the expression vector in the genome of a cell and moreover that the higher gene expression level is also more stable than in the absence of the DNA sequence with a gene transcription modulating quality.

In experiments designed to introduce a gene of interest into the genome of a cell and to obtain expression of the gene of interest, the following has been observed. If together with the gene of interest also a DNA sequence with a gene transcription modulating quality was introduced, more clones could be detected that expressed more than a certain amount of gene product of the gene of interest, than when the DNA sequence was not introduced together with the gene of interest. Thus an identified DNA sequence with gene transcription modulating quality also provides a method for increasing the number of cells expressing more than a certain level of a gene product of a gene of interest upon providing the gene of interest to the genome of the cells, comprising providing the cell with a DNA sequence comprising a gene transcription modulating quality together with the gene of interest.

The chances of detecting a fragment with a gene transcription-modulating quality vary with the source from which the fragments are derived. Typically, there is no prior knowledge of the presence or absence of fragments with that quality. In those situations many fragments will not comprise a DNA sequence with a gene transcription-modulating quality. In these situations a formal selection step for DNA sequences with that quality is introduced. This is done by selection vectors comprising the sequence on the basis of a feature of a product of the reporter gene, that can be selected for or against. For instance, the gene product may induce fluorescence or a color deposit (e.g., green fluorescent protein and derivatives, luciferase, or alkaline phosphatase) or confer antibiotic resistance or induce apoptosis and cell death.

A method for the identification of a DNA sequence with a gene transcription modulating quality is particularly suited for detecting and optionally selecting a DNA sequence comprising a gene transcription-enhancing quality. It has been observed that at least some of the selected DNA sequences, when incorporated into an expression vector comprising a gene of interest, can dramatically increase gene transcription of the gene of interest in a host cell even when the vector does not comprise an element with a gene-transcription repressing quality. This gene transcription enhancing quality is very useful in cell lines transfected with foreign genes or in transgenic animals and plants.

The transcription system can be a cell free in vitro transcription system. With the current expertise in automation such cell free systems can be accurate and quick. However, the transcription system preferably comprises host cells. Using host cells warrants that fragments are detected and optionally selected with activity in cells.

An element with a gene transcription repressing quality will repress transcription from a promoter in the transcription system used. Repression does not have to lead to undetectable expression levels. Important is that the difference in expression levels in the absence or presence of repression is detectable and optionally selectable. Preferably, gene-transcription repression in the vectors results in gene-transcription repressing chromatin. Preferably, DNA sequences can be detected, and optionally selected that are capable of at least in part counteracting the formation of gene-transcription repressing chromatin. In one aspect a DNA sequence capable of at least in part counteracting the formation of gene-transcription repressing chromatin comprises a stable gene transcription quality. Preferably, the DNA sequence involved in gene-transcription repression is a DNA sequence that is recognized by a protein complex and wherein the transcription system comprises the complex. Preferably, the complex comprises a heterochromatin-binding protein comprising HP1, a Polycomb-group (Pc-G) protein, a histone deacetylase activity or MeCP2 (methyl-CpG-binding protein). Many organisms comprise one or more of these proteins. These proteins frequently exhibit activity in other species as well. The complex can thus also comprise proteins from two or more species. The mentioned set of known chromatin-associated protein complexes are able to convey long-range repression over many base pairs. The complexes are also involved in stably transferring the repressed status of genes to daughter cells upon cell division.

Sequences selected in this way are able to convey long-range anti-repression over many base pairs (van der Vlag et al., 2000).

The vector used can be any vector that is suitable for cloning DNA and that can be used in a transcription system. When host cells are used it is preferred that the vector is an episomally replicating vector. In this way, effects due to different sites of integration of the vector are avoided. DNA elements flanking the vector at the site of integration can have effects on the level of transcription of the promoter and thereby mimic effects of fragments comprising DNA sequences with a gene transcription modulating quality. In a preferred embodiment, the vector comprises a replication origin from the Epstein-Barr virus (EBV), OriP, and a nuclear antigen (EBNA-1). Such vectors are capable of replicating in many types of eukaryotic cells and assemble into chromatin under appropriate conditions.

DNA sequences with gene transcription modulating quality can be obtained from different sources, for example, from a plant or vertebrate, or derivatives thereof, or a synthetic DNA sequence or one constructed by means of genetic engineering. Preferably, the DNA sequence comprises a sequence as depicted in Table 3 and/or SEQ ID NOs:1-119 and/or a functional equivalent and/or a functional fragment thereof. SEQ ID NOs:1-119 comprise STAR1-STAR65 (SEQ ID NOS:1-65); sequences comprising STAR66 and testing set (SEQ ID NOS:66-84); and sequences comprising *Arabidopsis* STAR A1-A35 (SEQ ID NOS:85-119) (herein after SEQ ID NOs:1-119).

Several methods are available in the art to extract sequence identifiers from a family of DNA sequences sharing a certain common feature. Such sequence identifiers can subsequently be used to identify sequences that share one or more identifiers. Sequences sharing such one or more identifiers are likely to be members of the same family of sequences, i.e., they are likely to share the common feature of the family. Herein, a large number of sequences comprising STAR activity (so-called STAR sequences or STAR elements) were used to obtain sequence identifiers (patterns) which are characteristic for sequences comprising STAR activity. These patterns can be used to determine whether a test sequence is likely to contain STAR activity. A method for detecting the presence of a STAR sequence within a nucleic acid sequence of about 50-5000 base pairs is thus herein provided, comprising determining the frequency of occurrence in the sequence of at least one sequence pattern and determining that the frequency of occurrence is representative of the frequency of occurrence of at least one sequence pattern in at least one sequence comprising a STAR sequence. In principle any method is suited for determining whether a sequence pattern is representative of a STAR sequence. Many different methods are available in the art. Preferably, the step of determining that the occurrence is representative of the frequency of occurrence of at least one sequence pattern in at least one sequence comprising a STAR sequence comprises, determining that the frequency of occurrence of at least one sequence pattern significantly differs between at least one STAR sequence and at least one control sequence. In principle any significant difference is discriminative for the presence of a STAR sequence. However, in a particularly preferred embodiment, the frequency of occurrence of at least one sequence pattern is significantly higher in at least one sequence comprising a STAR sequence compared to at least one control sequence.

As described above, a considerable number of sequences comprising a STAR sequence have been identified herein. It is possible to use these sequences to test how efficient a pattern is in discriminating between a control sequence and a sequence comprising a STAR sequence. Using so-called discriminant analysis it is possible to determine on the basis of any set of STAR sequences in a species, the most optimal discriminative sequence patters or combination thereof. Thus, preferably, at least one of the patterns is selected on the basis of optimal discrimination between at least one sequence comprising a STAR sequence and a control sequence.

Preferably, the frequency of occurrence of a sequence pattern in a test nucleic acid is compared with the frequency of occurrence in a sequence known to contain a STAR sequence. In this case a pattern is considered representative for a sequence comprising a STAR sequence if the frequencies of occurrence are similar. Even more preferably, another criterion is used. The frequency of occurrence of a pattern in a sequence comprising a STAR sequence is compared to the frequency of occurrence of the pattern in a control sequence. By comparing the two frequencies it is possible to determine for each pattern thus analyzed, whether the frequency in the sequence comprising the STAR sequence is significantly different from the frequency in the control sequence. Then a sequence pattern is considered to be representative of a sequence comprising a STAR sequence, if the frequency of occurrence of the pattern in at least one sequence comprising a STAR sequence is significantly different from the frequency of occurrence of the same pattern in a control sequence. By using larger numbers of sequences comprising a STAR sequence the number of patterns for which a statistical difference can be established increases, thus enlarging the number of patterns for which the frequency of occurrence is representative for a sequence comprising a STAR sequence. Preferably, the frequency of occurrence is representative of the frequency of occurrence of at least one sequence pattern in at least two sequences comprising a STAR sequence, more preferably, in at least five sequences comprising a STAR sequence. More preferably, in at least ten sequences comprising a STAR sequence. More preferably, the frequency of occurrence is representative of the frequency of occurrence of at least one sequence pattern in at least 20 sequences comprising a STAR sequence. Particularly preferred, the frequency of occurrence is representative of the frequency of occurrence of at least one sequence pattern in at least 50 sequences comprising a STAR.

The patterns that are indicative for a sequence comprising a STAR sequence are also dependent on the type of control nucleic acid used. The type of control sequence used is preferably selected on the basis of the sequence in which the presence of a STAR sequence is to be detected. Preferably, the control sequence comprises a random sequence comprising a similar AT/CG content as at least one sequence comprising a STAR sequence. Even more preferably, the control sequence is derived from the same species as the sequence comprising the STAR sequence. For instance, if a test sequence is scrutinized for the presence of a STAR sequence, active in a plant cell, then preferably, the control sequence is also derived from a plant cell. Similarly, for testing for STAR activity in a human cell, the control nucleic acid is preferably also derived from a human genome. Preferably, the control sequence comprises between 50% and 150% of the bases of at least one sequence comprising a STAR sequence. Particularly preferred, the control sequence comprises between 90% and 110% of the bases of at least one sequence comprising a STAR sequence. More preferably, between 95% and 105%.

A pattern can comprise any number of bases larger than two. Preferably, at least one sequence pattern comprises at least five, more preferably, at least six bases. Even more preferably, at least one sequence pattern comprises at least eight bases. Preferably, at least one sequence pattern comprises a pattern listed in Table 4 and/or Table 5. A pattern may consist of a consecutive list of bases. However, the pattern may also comprise bases that are interrupted one or more times by a number of bases that are not, or only, partly discriminative. A partly discriminative base is for instance indicated as a purine.

Preferably, the presence of STAR activity is verified using a functional assay. Several methods are presented herein to determine whether a sequence comprises STAR activity. STAR activity is confirmed if the sequence is capable of performing at least one of the following functions: (i) at least in part inhibiting the effect of a sequence comprising a gene transcription repressing element of the invention, (ii) at least in part blocking chromatin-associated repression, (iii) at least in part blocking activity of an enhancer, (iv) conferring upon an operably linked nucleic acid encoding a transcription unit compared to the same nucleic acid alone. (iv-a) a higher predictability of transcription, (iv-b) a higher transcription, and/or (iv-c) a higher stability of transcription over time.

The large number of sequences comprising STAR activity identified herein open up a wide variety of possibilities to generate and identify sequences comprising the same activity in kind, but not necessarily in amount. For instance, it is well within the reach of a skilled person to alter the sequences identified herein and test the altered sequence for STAR activity. Such altered sequences are, therefore, also included herein and can be used in a method for obtaining a cell which expresses two or more proteins or in a method for identifying a cell wherein expression of two or more proteins is in a predetermined ratio. Alteration can include deletion, insertion and mutation of one or more bases in the sequences.

Sequences comprising STAR activity were identified in stretches of 400 bases. However, it is expected that not all of these 400 bases are required to retain STAR activity. Methods to delimit the sequences that confer a certain property to a fragment of between 400 and 5000 bases are well known. The minimal sequence length of a fragment comprising STAR activity is estimated to be about 50 bases.

Tables 4 and 5 list patterns of 6 bases that have been found to be over represented in nucleic acid molecules comprising STAR activity. This over representation is considered to be representative for a STAR sequence. The tables were generated for a family of 65 STAR sequences. Similar tables can be generated starting from a different set of STAR sequences, or from a smaller or larger set of STAR sequences. A pattern is representative for a STAR sequence if it is over represented in the STAR sequence compared to a sequence not comprising a STAR element. This can be a random sequence. However, to exclude a non-relevant bias, the sequence comprising a STAR sequence is preferably compared to a genome or a significant part thereof, more preferably, a genome of a vertebrate or plant, and even more preferably, a human genome. A significant part of a genome is for instance a chromosome. Preferably, the sequence comprising a STAR sequence and the control sequence are derived from a nucleic acid of the same species.

The more STAR sequences are used for the determination of the frequency of occurrence of sequence patterns, the more representative for STARS the patterns are that are over- or under-represented. Considering that many of the functional features that can be displayed by nucleic acids are mediated by proteinaceous molecules binding to it, it is preferred that the representative pattern is over-represented in the STAR sequences. Such an over-represented pattern can be part of a binding site for such a proteinaceous molecule. Preferably, the frequency of occurrence is representative of the frequency of occurrence of at least one sequence pattern in at least two sequences comprising a STAR sequence, more preferably, in at least five sequences comprising a STAR sequence, and even more preferably, in at least ten sequences comprising a STAR sequence. More preferably, the frequency of occurrence is representative of the frequency of occurrence of at least one sequence pattern in at least 20 sequences comprising a STAR sequence. Particularly preferred, the frequency of occurrence is representative of the frequency of occurrence of at least one sequence pattern in at least 50 sequences comprising a STAR. Preferably, the sequences comprising a STAR sequence comprise at least one of the sequences depicted in SEQ ID NOs:1-119.

STAR activity is a feature shared by the sequences listed in SEQ ID NOs:1-119. However, this does not mean that they must all share the same identifier sequence. It is very well possible that different identifiers exist. Identifiers may confer this common feature onto a fragment containing it, though this is not necessarily so.

By using more sequences comprising STAR activity for determining the frequency of occurrence of a sequence pattern or patterns, it is possible to select patterns that are more often than others present or absent in such a STAR sequence. In this way it is possible to find patterns that are very frequently over or under represented in STAR sequences. Frequently over or under represented patterns are more likely to identify candidate STAR sequences in test sets. Another way of using a set of over or under represented patterns is to determine which pattern or combination of patterns is best suited to identify a STAR in a sequence. Using so-called discriminant statistics we have identified a set of patterns which performs best in identifying a sequence comprising a STAR element. Preferably, at least one of the sequence patterns for detecting a STAR sequence comprises a sequence pattern GGACCC (SEQ ID NO:505), CCCTGC (SEQ ID NO:247), AAGCCC (SEQ ID NO:311), CCCCCA (SEQ ID NO:339) and/or AGCACC (SEQ ID NO:377). Preferably, at least one of the sequence patterns for detecting a STAR sequence comprises a sequence pattern CCCN{16}AGC (SEQ ID NO:456), GGCN{9}GAC (SEQ ID NO:577), CACN{13}AGG (SEQ ID NO:802), and/or CTGN{4}GCC (SEQ ID NO:880).

A list of STAR sequences can also be used to determine one or more consensus sequences therein. A consensus sequence for a STAR element is, therefore, also provided herein. This consensus sequence can of course be used to identify candidate STAR elements in a test sequence.

Moreover, once a sequence comprising a STAR element has been identified in a vertebrate it can be used by means of sequence homology to identify sequences comprising a STAR element in other species belonging to a vertebrate. Preferably, a mammalian STAR sequence is used to screen for STAR sequences in other mammalian species. Similarly, once a STAR sequence has been identified in a plant species it can be used to screen for homologous sequences with similar function in other plant species. STAR sequences obtainable by a method as described herein are thus provided. Further provided is a collection of STAR sequences. Preferably, the STAR sequence is a vertebrate or plant STAR sequence. More preferably, the STAR sequence is a mammalian STAR sequence or an angiosperm (monocot, such as rice or dicot, such as *Arabidopsis*). More preferably, the STAR sequence is a primate and/or human STAR sequence.

A list of sequences comprising STAR activity can be used to determine whether a test sequence comprises a STAR element. There are, as mentioned above, many different methods for using such a list for this purpose. Preferably, a method is provided for determining whether a nucleic acid sequence of about 50-5000 base pairs comprises a STAR sequence, this method comprising: generating a first table of sequence patterns comprising the frequency of occurrence of the patterns in a collection of STAR sequences of the invention, generating a second table of the patterns comprising the frequency of occurrence of the patterns in at least one reference sequence, selecting at least one pattern of which the frequency of occurrence differs between the two tables, determining, within the nucleic acid sequence of about 50-5000 base pairs, the frequency of occurrence of at least one of the selected patterns, and determining whether the occurrence in the test nucleic acid is representative of the occurrence of the selected pattern in the collection of STAR sequences. Alternatively, the determining step comprises determining whether the frequency of occurrence in the test nucleic acid is representative of the frequency of occurrence of the selected pattern in the collection of STAR sequences. Preferably, the method further comprises determining whether the candidate STAR comprises a gene transcription modulating quality using a method described herein. Preferably, the collection of STARs comprises the sequences as depicted in SEQ ID NOs:1-119.

Now multiple methods are disclosed for obtaining a STAR sequence, it is clear that we also provide an isolated and/or recombinant nucleic acid sequence comprising a STAR sequence by a method as described herein.

A STAR sequence can exert its activity in a directional way, i.e., more to one side of the fragment containing it than to the other. Moreover, STAR activity can be amplified in amount by multiplying the number of STAR elements. The latter suggests that a STAR element may comprise one or more elements comprising STAR activity. Another way of identifying a sequence capable of conferring STAR activity on a fragment containing it comprises selecting from a vertebrate or plant sequence, a sequence comprising STAR activity and identifying whether sequences flanking the selected sequence are conserved in another species. Such conserved flanking sequences are likely to be functional sequences. Such a method for identifying a sequence comprising a STAR element comprising selecting a sequence of about 50 to 5000 base pairs from a vertebrate or plant species comprising a STAR element and identifying whether sequences flanking the selected sequence in the species are conserved in at least one other species. We further provide a method for detecting the presence of a STAR sequence within a nucleic acid sequence of about 50-5000 base pairs, comprising identifying a sequence comprising a STAR sequence in a part of a chromosome of a cell of a species and detecting significant homology between the sequence and a sequence of a chromosome of a different species. The STAR in the different species is thus identified. Preferably, the species comprises a plant or vertebrate species, preferably, a mammalian species. We also provide a method for detecting the presence of a STAR element within a nucleic acid sequence of about 50-5000 base pairs of a vertebrate or plant species, comprising identifying whether a flanking sequence of the nucleic acid sequence is conserved in at least one other species.

It is important to note that methods as disclosed herein for detecting the presence of a sequence comprising a STAR sequence using bioinformatical information are iterative in nature. The more sequences comprising a STAR sequence that are identified with a method as described herein, the more patterns are found to be discriminative between a sequence comprising a STAR sequence and a control sequence. Using these newly found discriminative patterns more sequences comprising a STAR sequence can be identified which in turn enlarge the set of patterns that can discriminate, and so on. This iterative aspect is an important aspect of methods provided herein.

The present invention provides, amongst others, a method for obtaining a cell which expresses two or more proteins, a method for identifying a cell wherein expression of two or more proteins is in a predetermined ratio and a protein expression unit. It is clear that in all these embodiments the above-described obtainable STAR sequences can be used. For example, a STAR sequence of SEQ ID NOs:1-119, Table 3, Table 4, or Table 5, or combinations thereof. More preferably, the STAR sequence is a vertebrate STAR sequence or a plant STAR sequence. Even more preferably, the vertebrate STAR sequence is a human STAR sequence. It is furthermore preferred to use a STAR sequence from a species from which a gene of interest is expressed. For example, when one would like to express two or more proteins and one of the proteins is a human protein, one preferably includes a human STAR sequence for the expression of the human protein.

As outlined above, the STAR elements flanking an expression unit are the basis of the stable expression of the monomer transgenes over many cell generations. We have demonstrated that STAR elements can protect individual transgenes from silencing. In the present invention that capability is extended to more than one expression unit introduced (preferentially) independently in a recombinant host cell. Expression units that are not flanked by STAR elements can undergo significant silencing after only 5-10 culture passages, during which time silencing of the STAR protected units is negligible.

The advantages of a method for obtaining a cell which expresses two or more proteins comprising providing the cell with two or more protein expression units encoding the two or more proteins, characterized in that at least two of the protein expression units comprise at least one STAR sequence, are multifold.

The present invention uses STAR sequences for the production of two or more proteins and thereby the invention provides (1) an increased predictability in the creation of recombinant cell lines that efficiently produce the heterologous multimeric proteins of interest, (2) an increased yield of the heterologous multimeric proteins, (3) stable expression of the heterologous multimeric proteins, even during prolonged cultivation in the absence of selection agent and (4) the invention also provides favorable transgene expression characteristics without amplification of the transgene. The increased yield of heterologous proteins provided by the invention may be obtained at low transgene copy numbers, without selective co-amplification using, for example, the DHFR/methotrexate system. This results in greater stability, since the transgene copy number is low and is not susceptible to decrease due to recombination (McBurney et al., 2002) or repeat-induced gene silencing (Garrick et al., 1998). Fifth, the broad applicability of the method of the invention includes its utility in a wide range of host cell lines. This is, for example, useful/desirable when a particular multimeric protein is preferably expressed by a particular host cell line (e.g., expression of antibodies from lymphocyte-derived host cell lines).

A method according to the invention, therefore, provides an improvement of expression of two or more proteins in a (host) cell.

In another embodiment, the invention provides a method for identifying a cell wherein expression of two or more proteins is in a predetermined ratio comprising providing:
a collection of cells with two or more protein expression units encoding the two or more proteins,
selecting cells which express two or more proteins, and
identifying from the obtained selection, cells that express two or more proteins in the predetermined ratio, characterized in that at least two of the protein expression units comprise at least one STAR sequence.

The selection of cells which express two or more proteins may, for example, be obtained by performing an SDS-PAGE analysis, a Western blot analysis or an ELISA, which are all techniques which are known by a person skilled in the art and, therefore, need no further elaboration. The identification of cells that express two or more proteins in the predetermined ratio can also be performed by these techniques.

The presence of a STAR sequence in at least two of the protein expression units, again, provide the desired predictability, yield, stability and stoichiometrically balanced availability of the two or more proteins.

Especially when polypeptides of a multimeric protein are produced according to a method of the invention it is desirable to provide the required monomers/subunits in a ratio that is relevant for the formation of the multimeric protein. Hence, preferably, the monomers/subunits are produced in a biological relevant balanced ratio. If, for example, a multimeric protein consists of two subunits A and one subunit B, it is desired to produce two subunits A for every subunit of B that is produced. Hence, a predetermined ratio is herein defined as the natural occurring ratio (stoichiometry) of the different subunits/monomers/polypeptides which comprise a multimeric protein.

In a more preferred embodiment, a cell obtainable according to a method of the invention expresses two proteins. For example, two proteins which together provide a therapeutically advantageous effect. In an even more preferred embodiment, the predetermined ratio of the two expressed proteins is 1:1. This is, for example, useful in the production of multimeric proteins in which the monomers are in a 1:1 ratio. Typical examples are antibodies that comprise two heavy chains and two light chains.

Preferably, the invention provides a method, wherein two or more protein expression units further encode at least two different selection markers, and wherein the method further comprises a two-step selection marker screening on the cell, wherein the cell is selected in a first step on the presence of a first selection marker and in a second step on the presence of a second selection marker.

In this embodiment of the invention, a two-stage antibiotic selection regime is used which results in a high proportion of isolates that express, for example, transgenes 1 and 2 at high levels; the first stage of selection eliminates cells that do not contain the expression unit or units, and the second stage of selection eliminates colonies that do not transcribe both bicistronic mRNAs at high levels. This regime is one of the aspects for the increased frequency of multimer-expressing recombinant cell lines achieved by the invention compared to conventional methods. As described herein, it results in an increase in the frequency of expresser lines by more than ten-fold.

In another embodiment, the invention provides a method wherein at least one of the protein expression units comprises a monocistronic gene comprising an open reading frame encoding a protein of interest and wherein the monocistronic gene is under control of a functional promoter.

In yet another embodiment, the invention provides a method, wherein at least one of the protein expression units comprises: a bicistronic gene comprising an open reading frame encoding a protein of interest, a protein translation initiation site with a reduced translation efficiency, and a selection marker, wherein the bicistronic gene is under control of a functional promoter.

In a more preferred embodiment, the invention provides a method, wherein at least one of the protein expression units comprises: a bicistronic gene comprising an open reading frame encoding a protein of interest, a protein translation initiation site with a reduced translation efficiency, and a selection marker, wherein the bicistronic gene is under control of a functional promoter, which protein expression unit further comprises: a monocistronic gene comprising an open reading frame encoding a second selection marker, wherein the monocistronic gene is under control of a functional promoter.

DESCRIPTION OF THE FIGURES

The drawings show representative versions of the DNA molecules of the invention. These portions of DNA, referred to as (a) protein expression unit(s), is/are created and manipulated in vectors such as recombinant plasmid molecules and/or recombinant viral genomes. The protein expression units are integrated into host cell genomes as part of the method of the invention, and the schematic drawings represent the configuration of the DNA elements in the expression units in both the vector molecules and the host cell genome.

FIG. 1A is a schematic diagram that shows the first expression unit. It is flanked by STAR elements, and comprises a bicistronic gene containing (from 5' to 3') a transgene (encoding, for example, a reporter gene or one subunit of a multimeric protein; TG S1, "transgene subunit 1"), an IRES, and a selectable marker (zeo, conferring zeocin resistance) under control of the CMV promoter. A monocistronic selectable marker (neo, conferring G418 resistance) under control of the SV40 promoter is included. Both genes have the SV40 transcriptional terminator at their 3' ends (t).

FIG. 1B is a schematic diagram that shows the second expression unit. It is flanked by STAR elements, and contains a bicistronic gene containing (from 5' to 3') a transgene (encoding, for example, a different reporter gene or another subunit of a multimeric protein; TG S2), an IRES, and a selectable marker (bsd, conferring blasticidin resistance) under control of the CMV promoter. A monocistronic selectable marker (neo, conferring G418 resistance) under control of the SV40 promoter is included. Both genes have the SV40 transcriptional terminator at their 3' ends.

FIG. 3A depicts pSDH-SIB/Z in which the bicistronic gene encodes secreted alkaline phosphatase (SEAP) in the 5' position and blasticidin (bsd) or zeocin (zeo) resistance selectable markers in the 3' position, relative to the IRES. FIG. 3B illustrates pSDH-GIB/Z in which the bicistronic gene encodes green fluorescent protein (GFP) in the 5' position and blasticidin (bsd) or zeocin (zeo) resistance selectable markers in the 3' position, relative to the IRES.

FIG. 4 is a comparison of the consequences of one-step and two-step antibiotic selection on the predictability of transgene expression. Recombinant CHO cell isolates containing plasmid pSDH-SIZ or plasmid pSDH-SIZ-STAR18 were selected on G418 (panel A) or sequentially on G418 and zeocin (panel B) and assayed for SEAP activity.

FIG. 5 is a schematic diagram illustrating the PP (Plug and Play) family of plasmids. These plasmids contain a bicistronic expression unit (containing an IRES) between multiple cloning sites (MCS) for insertion of STAR elements. MCSI, SbfI-SalI-XbaI-AscI-SwaI; MCSII, BsiWI-EcoRV-BglII-PacI. Panel A, the bicistronic gene encodes GFP and the puromycin resistance marker (puro). Panel B, the bicistronic gene encodes secreted alkaline phosphatase (SEAP) and the zeocin resistance marker (zeo). Panel C, the bicistronic gene encodes SEAP and the neocin resistance marker (neo). Panel D, the bicistronic gene encodes GFP and puro, and an adjacent monocistronic gene encodes neo. Panel E, the bicistronic gene encodes SEAP and zeo, and an adjacent monocistronic gene encodes neo. Bicistronic genes are under control of the CMV promoter (pCMV) and the monocistronic gene is under control of the SV40 promoter (pSV40). A stuffer fragment of 0.37 kb (St) separates MCSI from pCMV. Both the bicistronic and monocistronic genes have the SV40 polyadenylation site at their 3' ends.

FIG. 12 is a schematic diagram illustrating the orientation of STAR elements as they are cloned in the pSelect vector (panel A), as they are cloned into pSDH vectors to preserve their native orientation (panel B), and as they are cloned into pSDH vector in the opposite orientation (panel C).

FIG. 23 includes schematic diagrams and a graph illustrating that STAR elements allow efficient and simultaneous expression of two genes from two distant vectors. The ppGIZ, ppGIZ-STAR7, ppRIP and ppRIP-STAR7 vectors used for testing simultaneous expression of respectively GFP and RED are shown. The expression unit comprises (from 5' to 3') genes encoding the GFP or RED proteins, an IRES, and a selectable marker (zeo, conferring zeocin resistance or respectively puro, puromycin resistance gene) under control of the CMV promoter. The expression unit has the SV40 transcriptional terminator at its 3' end (t). The cassettes with the GFP and RED expression units are either flanked by STAR7 elements (SEQ ID NO:7) (STAR7-shielded) or not (Control). The two control constructs or the two STAR7-shielded vectors are simultaneously transfected to CHO-K1 cells. Stable colonies that are resistant to both zeocin and puromycin are expanded and the GFP and RED signals are determined on a XL-MCL Beckman Coulter flow cytometer. The percentage of cells in one colony that are double positive for both GFP and RED signals is taken as measure for simultaneous expression of both proteins and this is plotted in FIG. 23.

DETAILED DESCRIPTION OF THE INVENTION

DEFINITIONS

Figure 2:
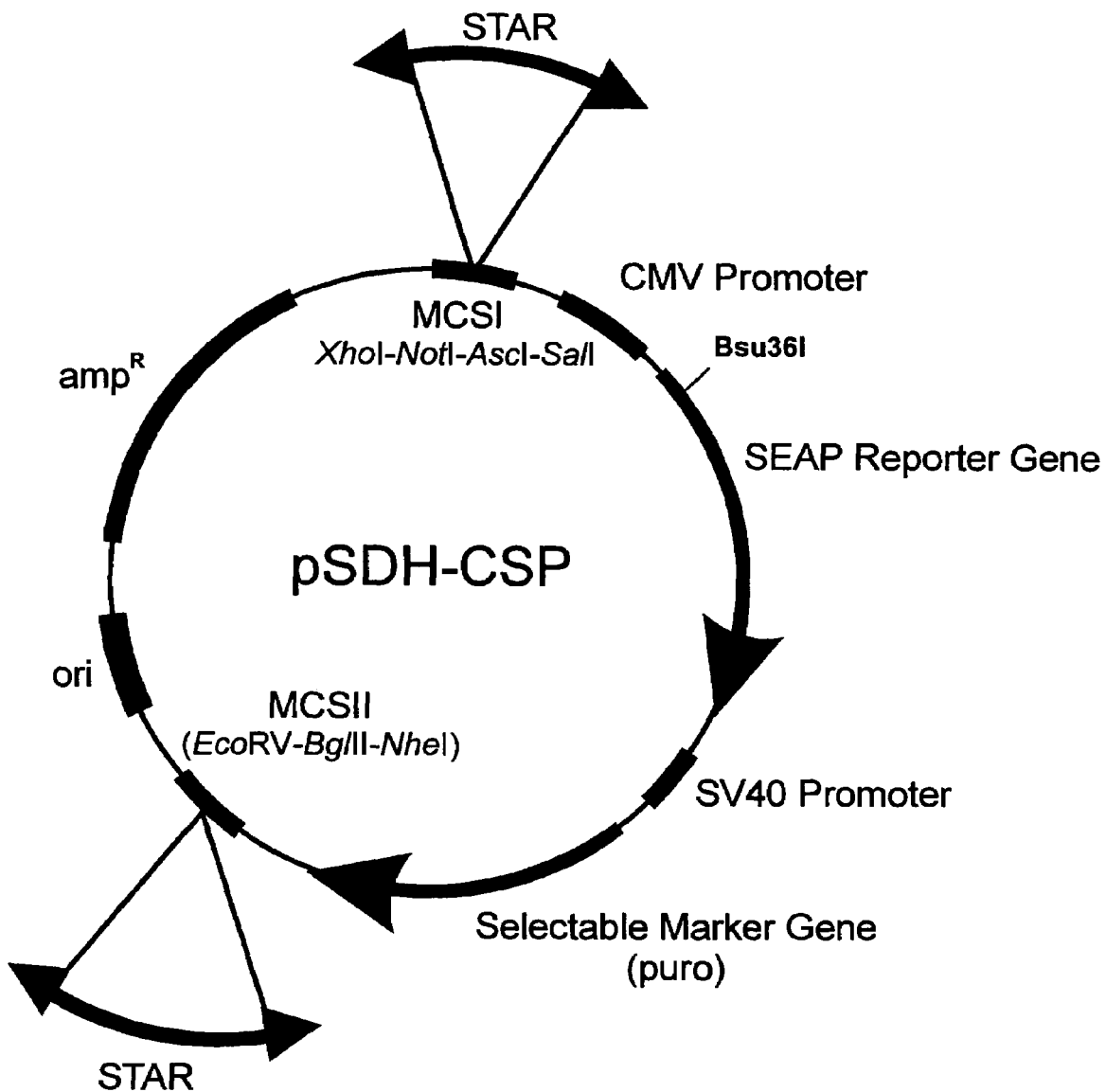
FIG. 2 is a diagram of the pSDH-CSP plasmid. The Secreted Alkaline Phosphatase (SEAP) reporter gene is under control of the CMV promoter, and the puromycin resistance selectable marker (puro) is under control of the SV40 promoter. Flanking these two genes are multiple cloning sites into which STAR elements can be cloned. The plasmid also has an origin of replication (ori) and ampicillin resistance gene (amp$^R$) for propagation in *Escherichia coli*.

Cell, Host Cell, Cell Line, Host Cell Line

The terms "cell"/"host cell" and "cell line"/"host cell line" are respectively typically defined as a eukaryotic cell and homogeneous populations thereof that are maintained in cell culture by methods known in the art, and that have the ability to express heterologous proteins.

Expression

The term "expression" is typically used to refer to the production of a specific RNA product or products, or a specific protein or proteins, in a cell. In the case of RNA products, it refers to the process of transcription. In the case of protein products, it refers to the processes of transcription, translation and optionally post-translational modifications. In the case of secreted proteins, it refers to the processes of transcription, translation, and optionally post-translational modification (e.g., glycosylation, disulfide bond formation, etc.), followed by secretion. In the case of multimeric proteins, it includes assembly of the multimeric structure from the polypeptide monomers. The corresponding verbs of the noun "expression" have an analogous meaning as the noun.

Protein, Multimer, Multimeric Protein

A protein is herein defined as being either (i) a product obtained by the processes of transcription and translation and possibly but not necessarily a product that is part of a multimeric protein (for example, a subunit) and/or (ii) a product obtained by the processes of transcription, translation and post-translational modification. The term "multimer" or "multimeric protein" is typically defined as a protein that comprises two or more, possibly non-identical, polypeptide chains ("monomers"). The different monomers in a multimeric protein can be present in stoichiometrically equal or unequal numbers. In either case, the proportion of the monomers is usually fixed by the functional structure of the multimeric protein.

Protein Expression Unit

The term "protein expression unit" is herein defined as a unit capable of providing protein expression and typically comprises a functional promoter, an open reading frame encoding a protein of interest and a functional terminator, all in operable configuration. A functional promoter is a promoter that is capable of initiating transcription in a particular cell. Suitable promoters for obtaining expression in eukaryotic cells are the CMV-promoter, a mammalian EF1-alpha promoter, a mammalian ubiquitin promoter, or a SV40 promoter. A functional terminator is a terminator that is capable of providing transcription termination. One example of a suitable terminator is an SV40 terminator.

An Open Reading Frame Encoding a Protein of Interest (or a Transgene)

The term "an open reading frame encoding a protein of interest (or a transgene)" is typically defined as a fragment of DNA which codes for a specific RNA product or products or a specific protein or proteins, and which is optionally capable of becoming integrated into the genome of a host cell. It includes DNA elements required for proper transcription and translation of the coding region(s) of the transgene. The DNA encoding the protein of interest/transgene can either be a DNA encoding a product obtained by the processes of transcription and translation (and possibly but not necessarily this product is part of a multimeric protein, for example, a subunit) or a product obtained by the processes of transcription, translation and post-translational modification.

Recombinant Cell, Recombinant Host Cell, Recombinant Cell Line, Recombinant Host Cell Line The terms "recombinant cell/host cell" and "recombinant cell line/host cell line" are respectively typically defined as a host cell and homogeneous populations thereof into which a transgene has been introduced for the purpose of producing a heterologous protein or proteins.

STAR (Stabilizing Anti-Repressor) Sequence & STAR Element

A STAR (STabilizing Anti-Repressor) sequence (or STAR element; these terms will be used interchangeably herein) is a naturally occurring DNA element that we have isolated from eukaryotic genomes on the basis of their ability to block transgene repression. Preferably, the STAR elements are recovered from the human genome. A STAR sequence comprises the capacity to influence transcription of genes in cis and/or provide a stabilizing and/or an enhancing effect. It has been demonstrated that when STAR elements flank transgenes, the transgene expression level of randomly selected recombinant cell lines can be increased to levels approaching the maximum potential expression of the transgene's promoter. Moreover, the expression level of the transgene is stable over many cell generations, and does not manifest stochastic silencing. Therefore, STAR sequences confer a degree of position-independent expression on transgenes that is not possible with conventional transgenic systems. The position independence means that transgenes that are integrated in genomic locations that would result in transgene silencing are, with the protection of STAR elements, maintained in a transcriptionally active state.

Quality

The term quality in relation to a sequence refers to an activity of the sequence.

STAR, STAR Sequence, STAR Element

The term STAR, STAR sequence or STAR element, as used herein, refers to a DNA sequence comprising one or more of the mentioned gene transcription modulating qualities.

DNA Sequence

The term "DNA sequence" as used herein does, unless otherwise specified, not refer to a listing of specific ordering of bases but rather to a physical piece of DNA. A transcription quality with reference to a DNA sequence refers to an effect that the DNA sequence has on transcription of a gene of interest. "Quality" as used herein refers to detectable properties or attributes of a nucleic acid or protein in a transcription system.

Bicistronic Gene

The term "bicistronic gene," is typically defined as a gene capable of providing a RNA molecule that encodes two proteins/polypeptides.

Monocistronic Gene

The term "monocistronic gene" is typically defined as a gene capable of providing a RNA molecule that encodes one protein/polypeptide.

Selection Marker or Selectable Marker

The term "selection marker or selectable marker" is typically used to refer to a gene and/or protein whose presence can be detected directly or indirectly in a cell, for example, a gene and/or a protein that inactivates a selection agent and protects the host cell from the agent's lethal or growth-inhibitory effects (e.g., an antibiotic resistance gene and/or protein). Another possibility is that the selection marker induces fluorescence or a color deposit (e.g., green fluorescent protein and derivatives, luciferase, or alkaline phosphatase).

Selection Agent

The term "selection agent" is typically defined as a chemical compound that is able to kill or retard the growth of host cells (e.g., an antibiotic).

Selection

The term "selection" is typically defined as the process of using a selection marker/selectable marker and a selection agent to identify host cells with specific genetic properties (e.g., that the host cell contains a transgene integrated into its genome).

Clone, Isolate

The nouns "clone" and "isolate" typically refer to a recombinant host cell line that has been identified and isolated by means of selection.

The improvements provided by a method according to the invention have three integrated aspects. (1) With existing systems, recombinant cell lines that simultaneously express acceptable quantities of the monomers of multimeric proteins can be created only at very low frequencies; the present invention increases the predictability of creating high-yielding recombinant host cell lines by a factor of ten or more. (2) Existing systems do not provide stoichiometrically balanced and proportional amounts of the subunits of multimeric proteins; the present invention ensures that the expression levels of the subunits will be balanced and proportional. (3) Existing systems do not provide a means of protecting the transgenes that encode the protein subunits from transgene silencing.

FIG. 1 provides a non-limiting schematic representation of one of the embodiments of this part of the invention. FIGS. 1A and 1B show two separate protein expression units. This is the configuration of the DNA elements of the expression units in the plasmid as well as after integration into the genome. Expression unit one is shown in FIG. 1A. It contains an open reading frame for a transgene (a reporter gene or subunit 1 of a multimeric (TG S1, transgene subunit 1)). This is upstream of the attenuated EMCV IRES, and of the open reading frame encoding the zeocin resistance selectable marker protein (zeo). This bicistronic transgene is transcribed at high levels from the CMV promoter. Next to this is the neomycin resistance selectable marker (neo; this confers resistance to the antibiotic G418 as well), transcribed as a monocistronic mRNA from the SV40 promoter. These two genes are flanked by STAR elements. In FIG. 1B a similar expression unit is depicted. It consists of a second transgene (a second reporter gene or the open reading frame for subunit 2 of a heterodimeric protein (TG S2)) upstream of the attenuated EMCV IRES and the blasticidin selectable marker open reading frame (bsd). This bicistronic transgene is transcribed at high levels from the CMV promoter. Next to this is the neo selectable marker, transcribed as a monocistronic mRNA from the SV40 promoter. The two genes in the second expression unit are flanked by STAR elements as well.

It is clear to a person skilled in the art that the possible combinations of selection markers are numerous. Examples of possible antibiotic combinations are provided above. The one antibiotic that is particularly advantageous is zeocin, because the zeocin-resistance protein (zeocin-R) acts by binding the drug and rendering it harmless. Therefore, it is easy to titrate the amount of drug that kills cells with low levels of zeocin-R expression, while allowing the high-expressors to survive. All other antibiotic-resistance proteins in common use are enzymes, and thus act catalytically (not 1:1 with the drug).

When a two-step selection is performed it is, therefore, advantageous to use an antibiotic resistance protein with this 1:1 binding mode of action. Hence, the antibiotic zeocin is a preferred selection marker. For convenience the zeocin antibiotic is in a two-step selection method combined with puromycin-R or blasticidin-R in the second bicistronic gene, and neomycin-R or hygromycin-R in the monocistronic gene.

It is furthermore clear that it is also possible to combine an antibiotic selection marker with a selection marker which provides induction of fluorescence or which provides a color deposit.

It is also clear to a person skilled in the art that different promoters can be used as long as they are functional in the used cell. The CMV promoter is considered the strongest available, so it is preferably chosen for the bicistronic gene in order to obtain the highest possible product yield. Other examples of suitable promoters are, e.g., mammalian promoters for EF1-alpha or ubiquitin. The good expression and stability of the SV40 promoter makes it well suited for expression of the monocistronic gene; enough selection marker protein (for example, the antibiotic resistance protein neomycin-R in the example cited herein) is made to confer high expression of the selection marker. Hence, the SV40 promoter is preferentially used as a promoter driving the expression of the selection marker.

In a preferred embodiment, the invention provides a method wherein at least one of the protein expression units comprises at least two STAR sequences. In an even more preferred embodiment, the invention provides a method wherein the protein expression unit comprising at least two STAR sequences is arranged such that the protein expression unit is flanked on either side by at least one STAR sequence. In yet an even more preferred embodiment, the at least two STAR sequences are essentially identical. Essentially identical STAR sequences are defined herein as STAR sequences which are identical in their important domains, but which may vary within their less important domains (the domains that confer the transcription stabilizing or enhancing quality), for example, a point mutation, deletion or insertion at a less important position within the STAR sequence. Preferentially, the essentially identical STAR sequences provide equal amounts of transcription stabilizing or enhancing activity.

The use of STAR sequences to flank at least one protein expression unit is one of the aspects of the balanced and proportional levels of expression of two or more proteins and more specifically for the expression of the monomers of multimeric proteins. The STAR sequences create chromatin domains of definite and stable transcriptional potential. As a result, promoters that drive transcription of each bicistronic mRNA will function at definite, stable levels. A recombinant host cell line created by the method of the invention is readily identified in which these levels result in appropriate proportions of each monomer of the multimeric protein of interest being expressed at high yields.

In another embodiment, the protein expression unit contains only the bicistronic gene flanked by STAR elements. The advantages of omitting the monocistronic antibiotic resistance gene are twofold. First, selection of high-expressing recombinant host cells requires the use of only two antibiotics. Second, it prevents repression of the bicistronic and/or monocistronic genes by the phenomena of promoter suppression and transcriptional interference. These phenomena are common problems in conventional transgenic systems in which two or more transcription units are located near each other. Repression by an upstream (5') unit of a downstream (3') unit is termed transcriptional interference, and repression by a downstream unit of an upstream unit is termed promoter suppression (Villemure et al., 2001). Transcriptional interference can result in suppression of adjacent transgenes in all possible arrangements (tandem, divergent, and convergent) (Eszterhas et al., 2002). These phenomena can reduce the efficiency of selection of the IRES-dependent and/or monocistronic antibiotic resistance genes, and reduce the yield of the transgene. Therefore, the embodiment of the invention comprising only a bicistronic gene flanked by STAR elements provides an alternative configuration of the components.

In a preferred embodiment, the method according to the invention uses a STAR sequence wherein the STAR sequence is depicted in Table 3 and/or SEQ ID NOs:1-119 and/or a functional equivalent and/or a functional fragment thereof.

We have isolated and characterized an extensive collection of STAR sequences using proprietary technology. The strength of these sequences ranges widely. This is manifested by the varying degrees of improvement of transgene expression in recombinant host cells conferred by the STAR elements; some STAR elements provide full protection from silencing, while others only provide partial protection. The range in strength of the STAR elements is also manifested in their varying capacities to improve the predictability of isolating recombinant cell lines that efficiently produce the heterologous proteins of interest. For the present invention we have preferably employed STAR elements that have strong predictability characteristics, in order to have high numbers of efficiently-expressing recombinant cell lines. The STAR elements employed have moderate to strong anti-repressor activity, in order to be able to modulate the levels of recombinant protein production to match the requirements of the product (e.g., balanced and proportional expression of polypeptide monomers). The selected STAR elements also confer significant increases on the stability of expression of the transgenes.

Some STAR elements also display promoter and host cell-type specificity. These characteristics are exploited to create novel transgenic systems to optimize the production of heterologous proteins that require a specific host cell (for example, to achieve a high yield or a pharmaceutically advantageous glycosylation pattern) or a specific mode of expression (for example, the use of an inducible promoter or a constitutive promoter; the use of a promoter with moderate strength or high strength, etc.). Therefore, the use of different STAR elements results in different embodiments of the invention that pertain to these types of applications.

A functional equivalent and/or a functional fragment of a sequence depicted in Table 3 and/or SEQ ID NOs:1-119 is defined herein as follows. A functional equivalent of a sequence as depicted in Table 3 and/or SEQ ID NOs:1-119 is a sequence derived with the information given in Table 3 and/or SEQ ID NOs:1-119. For instance, a sequence that can be derived from a sequence in Table 3 and/or SEQ ID NOs:1-119 by deleting, modifying and/or inserting bases in or from a sequence listed in Table 3 and/or SEQ ID NOs:1-119, wherein the derived sequence comprises the same activity in kind, not necessarily in amount, of a sequence as depicted in Table 3 and/or SEQ ID NOs:1-119. A functional equivalent is further a sequence comprising a part from two or more sequences depicted in Table 3 and/or SEQ ID NOs:1-119. A functional equivalent can also be a synthetic DNA sequence which is a sequence that is not derived directly or indirectly from a sequence present in an organism. For instance, a sequence comprising a drosophila scs or scs' sequence is not a synthetic sequence, even when the scs or scs' sequence was artificially generated.

Functional sequences of STAR elements can be delineated by various methods known in the art. In one embodiment, deletions and/or substitutions are made in STAR sequences. DNA that is modified in such a way is, for example, tested for activity by using a single modified nucleic acid or by generating a collection of test nucleic acids comprising the modified nucleic acid. Elucidation of functional sequences within STAR sequences enables the elucidation of consensus sequences for elements with a gene transcription modulating and/or a gene transcription repressing quality.

A functional fragment of a STAR sequence as depicted in Table 3 and/or SEQ ID NOs:1-119 can, for example, be obtained by deletions from the 5' end or the 3' end or from the inside of the sequences or any combination thereof, wherein the derived sequence comprises the same activity in kind, not necessarily in amount.

In a more preferred embodiment, the STAR sequence as depicted in Table 3 and/or SEQ ID NOs:1-119 is STAR18 and/or a functional equivalent and/or a functional fragment thereof.

Yet another preferred feature of a method according to the invention is the introduction of a (weak) IRES as an example of a protein translation initiation site with a reduced translation efficiency, between the open reading frame of the protein of interest and the selection marker open reading frame. In combination with, for example, the STAR sequence, this component of the present invention comprises a marked improvement in transgenic systems for the expression of two or more proteins.

IRES elements are known from viral and mammalian genes (Martinez-Salas, 1999), and have also been identified in screens of small synthetic oligonucleotides (Venkatesan & Dasgupta, 2001). The IRES from the encephalomyocarditis virus has been analyzed in detail (Mizuguchi et al., 2000). An IRES is an element encoded in DNA that results in a structure in the transcribed RNA at which eukaryotic ribosomes can bind and initiate translation. An IRES permits two or more proteins to be produced from a single RNA molecule (the first protein is translated by ribosomes that bind the RNA at the cap structure of its 5' terminus, (Martinez-Salas, 1999)). Translation of proteins from IRES elements is less efficient than cap-dependent translation: the amount of protein from IRES-dependent open reading frames (ORFs) ranges from less than 20% to 50% of the amount from the first ORF (Mizuguchi et al., 2000). This renders IRES elements undesirable for production of all subunits of a multimeric protein from one messenger RNA (mRNA), since it is not possible to achieve balanced and proportional expression of two or more protein monomers from a bicistronic or multicistronic mRNA. However, the reduced efficiency of IRES-dependent translation provides an advantage that is exploited by the current invention. Furthermore, mutation of IRES elements can attenuate their activity, and lower the expression from the IRES-dependent ORFs to below 10% of the first ORF (Lopez de Quinto & Martinez-Salas, 1998, Rees et al., 1996). The advantage exploited by the invention is as follows: when the IRES-dependent ORF encodes a selectable marker protein, its low relative level of translation means that high absolute levels of transcription must occur in order for the recombinant host cell to be selected. Therefore, selected recombinant host cell isolates will by necessity express high amounts of the transgene mRNA. Since the recombinant protein is translated from the cap-dependent ORF, it can be produced in abundance resulting in high product yields.

It is clear to a person skilled in the art that changes to the IRES can be made without altering the essence of the function of the IRES (hence, providing a protein translation initiation site with a reduced translation efficiency), resulting in a modified IRES. Use of a modified IRES which is still capable of providing a small percentage of translation (compared to a 5' cap translation) is, therefore, also included in this invention.

In yet another embodiment, the invention provides a method for obtaining a cell which expresses two or more proteins or a method for identifying a cell wherein expression of two or more proteins is in a predetermined ratio, wherein each of the protein expression units resides on a separate DNA-carrier. The present invention preferentially makes use of a separate transcription unit for each protein and/or monomer of a multimeric protein. In each transcription unit the monomer ORF is produced by efficient cap-dependent translation. This feature of the invention provides isolated recombinant host cells that have high yields of each monomer, at levels that are balanced and proportionate to the stoichiometry of the multimeric protein. The increased predictability at which such recombinant host cells are isolated results in an improvement in the efficiency of screening for such isolates by a factor of ten or more. In a preferred embodiment, the DNA-carrier is a vector (or plasmid; the terms are used interchangeably herein). In another embodiment, the vector is a viral vector and in a more preferred embodiment, the viral vector is an adenoviral vector or a retroviral vector. It is clear to persons skilled in the art that other viral vectors can also be used in a method according to the invention.

Conventional expression systems are DNA molecules in the form of a recombinant plasmid or a recombinant viral genome. The plasmid or the viral genome is introduced into (mammalian host) cells and integrated into their genomes by methods known in the art. The present invention also uses these types of DNA molecules to deliver its improved transgene expression system. A preferred embodiment of the invention is the use of plasmid DNA for delivery of the expression system. A plasmid contains a number of components: conventional components, known in the art, are an origin of replication and a selectable marker for propagation of the plasmid in bacterial cells; a selectable marker that functions in eukaryotic cells to identify and isolate host cells that carry an integrated transgene expression system; the protein of interest, whose high-level transcription is brought about by a promoter that is functional in eukaryotic cells (e.g., the human cytomegalovirus major immediate early promoter/enhancer, pCMV (Boshart et al., 1985)); and viral transcriptional terminators for the transgene of interest and the selectable marker (e.g., the SV40 polyadenylation site (Kaufman & Sharp, 1982)).

The vector used can be any vector that is suitable for cloning DNA and that can be used in a transcription system. When host cells are used it is preferred that the vector is an episomally replicating vector. In this way, effects due to different sites of integration of the vector are avoided. DNA elements flanking the vector at the site of integration can have effects on the level of transcription of the promoter and thereby mimic effects of fragments comprising DNA sequences with a gene transcription modulating quality. In a preferred embodiment, the vector comprises a replication origin from the Epstein-Barr virus (EBV), OriP, and a nuclear antigen (EBNA-1). Such vectors are capable of replicating in many types of eukaryotic cells and assemble into chromatin under appropriate conditions.

In a preferred embodiment, the invention provides a method for obtaining a cell which expresses two or more proteins or a method for obtaining a cell wherein expression of two or more proteins is in a predetermined ratio comprising providing two or more protein expression units wherein one of the protein expression units or protein(s) of interest encodes an immunoglobulin heavy chain and/or wherein another of the protein expression units or protein(s) of interest encodes an immunoglobulin light chain. According to this embodiment, a multimeric protein, an antibody, is obtained. It is clear to a person skilled in the art that it is possible to provide a cell which expresses an immunoglobulin heavy chain from one protein expression unit and an immunoglobulin light chain from another protein expression unit with a third protein expression unit encoding a secretory component or a joining chain. In this way the production of, for example, sIgA and pentameric IgM is provided.

Preferably, the used host cell secretes the produced multimer. In this way the product is easily isolated from the medium surrounding the host cell.

More preferably, the invention results in the production of a functional multimer. The functionality of the produced multimer is determined with standard procedures. For example, a produced multi subunit enzyme is tested in a corresponding enzymatic assay or by binding to an antigen, for example, in an ELISA used to test the functionality of a produced antibody.

Hence, the selection of a final suitable host cell expressing a multimer involves multiple steps amongst which are the selection for a cell that expresses all the desired subunits of a multimer, followed by a functional analysis of the multimer.

With regard to a multimeric protein, high expression levels of the subunits is desired as well as the formation of a functional multimeric protein of the subunits. Surprisingly, the use of a STAR sequence for the production of the subunits of a multimeric protein results in a high amount of cells that express the subunits, as compared to control vectors without a STAR sequence. Moreover, the amount of functional multimeric protein is relatively higher when compared to the control.

Production of subunits and the formation of functional multimeric protein from these subunits is in particular of importance for the production of antibodies. When the heavy chain and light chain expression cassette are flanked by a STAR sequence this results in a higher production of functional antibody, as compared to control vectors without a STAR sequence. Hence, the presence of a STAR sequence results in a higher degree of predictability of functional antibody expression. Preferably, each expression unit comprises at least two STAR sequences which sequences are arranged such that the expression unit is flanked on either side by at least one STAR sequence.

In yet another embodiment, a method according to the invention is provided, wherein the protein expression units are introduced simultaneously into the cell.

Preferably, a functional promoter is a human cytomegalovirus (CMV) promoter, a simian virus (SV40) promoter, a human ubiquitin C promoter or a human elongation factor alpha (EF1-α) promoter.

As disclosed herein within the experimental part, a STAR sequence can confer copy number-dependence on a transgene expression unit, making transgene expression independent of other transgene copies in tandem arrays, and independent of gene-silencing influences at the site of integration. Hence, the invention also provides a method for obtaining a cell which expresses two or more proteins or a method for identifying a cell wherein expression of two or more proteins is in a predetermined ratio in which multiple copies of a protein expression unit encoding a protein of interest is integrated into the genome of the cell (i.e., in which cell, an amplification of the gene of interest is present).

According to this part of the invention, the protein expression units are introduced simultaneously into the (host) cell or collection of cells by methods known in the art. Recombinant host cells are selected by treatment with an appropriate antibiotic, for example, G418, using methods known in the art. After formation of individual antibiotic-resistant colonies, another antibiotic or a combination of antibiotics, for example, a combination of zeocin and blasticidin, is/are applied, and antibiotic-resistant colonies are identified and isolated. These are tested for the level of expression of transgenes.

In another embodiment, the invention provides a protein expression unit comprising:
  a bicistronic gene comprising an open reading frame encoding a protein of interest, a protein translation initiation site with a reduced translation efficiency, a selection marker and wherein the bicistronic gene is under control of a functional promoter
  at least one STAR sequence.

In a more preferred embodiment, the protein expression unit further comprises: a monocistronic gene comprising an open reading frame encoding a second selection marker and wherein the monocistronic gene is under control of a functional promoter.

In an even more preferred embodiment, the protein expression unit comprises at least two STAR sequences which are preferentially arranged such that the protein expression unit is flanked on either side by at least one STAR sequence. Examples of such a protein expression unit are provided within the experimental part of this patent application (for example, FIGS. 1 and 5).

In another embodiment, the protein expression unit according to the invention comprises STAR sequences, wherein the STAR sequences are essentially identical.

In a preferred embodiment, the invention provides a protein expression unit comprising:
  a bicistronic gene comprising an open reading frame encoding a protein of interest, a protein translation initiation site with a reduced translation efficiency, a selection marker and wherein the bicistronic gene is under control of a functional promoter
  at least one STAR sequence, and is optionally provided with a monocistronic gene cassette, wherein the STAR sequence is depicted in Table 3 and/or SEQ ID NOs:

1-119 and/or a functional equivalent and/or a functional fragment thereof and even more preferred wherein the STAR sequence is STAR18.

In another embodiment, a protein expression unit according to the invention is provided wherein the protein translation initiation site with a reduced translation efficiency comprises an IRES. More preferably, a modified, e.g., weaker, IRES is used.

In yet another embodiment, a protein expression unit according to the invention is provided wherein the protein expression unit is a vector. In a preferred embodiment, the DNA-carrier is a vector (or plasmid; the terms are used interchangeably herein). In another embodiment, the vector is a viral vector and in a more preferred embodiment, the viral vector is an adenoviral vector or a retroviral vector. It is clear to a person skilled in the art that other viral vectors can also be used in a method according to the invention.

In a preferred embodiment, a protein expression unit according to the invention is provided, wherein the protein of interest is an immunoglobulin heavy chain. In yet another preferred embodiment, a protein expression unit according to the invention is provided, wherein the protein of interest is an immunoglobulin light chain. When these two protein expression units are present within the same (host) cell a multimeric protein and more specifically an antibody is assembled.

The invention includes a cell provided with a protein expression unit comprising a STAR.

The invention also includes a (host) cell comprising at least one protein expression unit according to the invention. Such a (host) cell is then, for example, used for large-scale production processes.

The invention also includes a cell obtainable according to anyone of the methods as described herein. The invention furthermore includes a protein obtainable from the cell (for example, via the process of protein purification). Preferably, the protein is a multimeric protein and even more preferably, the multimeric protein is an antibody. Such an antibody can be used in pharmaceutical and/or diagnostic applications.

The foregoing discussion and the following examples are provided for illustrative purposes, and they are not intended to limit the scope of the invention as claimed herein. They simply provide some of the preferred embodiments of the invention. Modifications and variations, which may occur to one of ordinary skill in the art, are within the intended scope of this invention. Various other embodiments apply to the present invention, including: other selectable marker genes; other IRES elements or means of attenuating IRES activity; other elements affecting transcription including promoters, enhancers, introns, terminators, and polyadenylation sites; other orders and/or orientations of the monocistronic and bicistronic genes; other anti-repressor elements or parts, derivations, and/or analogues thereof; other vector systems for delivery of the inventive DNA molecules into eukaryotic host cells; and applications of the inventive method to other transgenic systems.

EXAMPLES

Example 1

STAR Elements and Two-step Selection Improve the Predictability of Transgene Expression One object of this invention is to improve transgene expression for heterologous protein production by using a two-step antibiotic selection procedure. The two-step procedure increases the predictability of finding recombinant host cell lines that express the transgene to high levels, thus increasing the yield of the heterologous protein.

Materials and Methods

Plasmid Construction

The pSDH-SIB/Z and pSDH-GIB/Z families of plasmids were constructed as follows: The zeocin selectable marker was recovered by polymerase chain reaction (PCR) amplification from plasmid pEM7/zeo (Invitrogen V500-20) using primers E99 and E100 (SEQ ID NOS:186 and 187, respectively) (all PCR primers and mutagenic oligonucleotide sequences are listed in Table 1), and cloned directionally into the XbaI and NotI sites of multiple cloning site (MCS) B of pIRES (Clontech 6028-1) to create pIRES-zeo. The blasticidin selectable marker was recovered by PCR from plasmid pCMV/bsd (Invitrogen V510-20) using primers E84 and E85 (SEQ ID NOS:176 and 177, respectively), and cloned directionally into the XbaI and NotI sites MCS-B of pIRES to create pIRES-bsd. The SEAP (secreted alkaline phosphatase) reporter gene was recovered by PCR from plasmid pSEAP2-basic (Clontech 6049-1) using primers F11 and E87 (SEQ ID NOS:188 and 178, respectively), and cloned directionally into MCS-A of pIRES-zeo and pIRES-bsd to create plasmids pIRES-SEAP-zeo and pIRES-SEAP-bsd. The GFP reporter gene was recovered from plasmid phr-GFP-1 (Stratagene 240059) by restriction digestion with NheI and EcoRI, and ligated directionally into MCS-A of pIRES-zeo and pIRES-bsd to create plasmids pIRES-GFP-zeo and pIRES-GFP-bsd. A linker was inserted at the non-methylated ClaI site of each of these plasmids (downstream of the neomycin resistance marker) to introduce an AgeI site using oligonucleotides F34 and F35 (SEQ ID NOS:204 and 205, respectively).

Figure 3A:
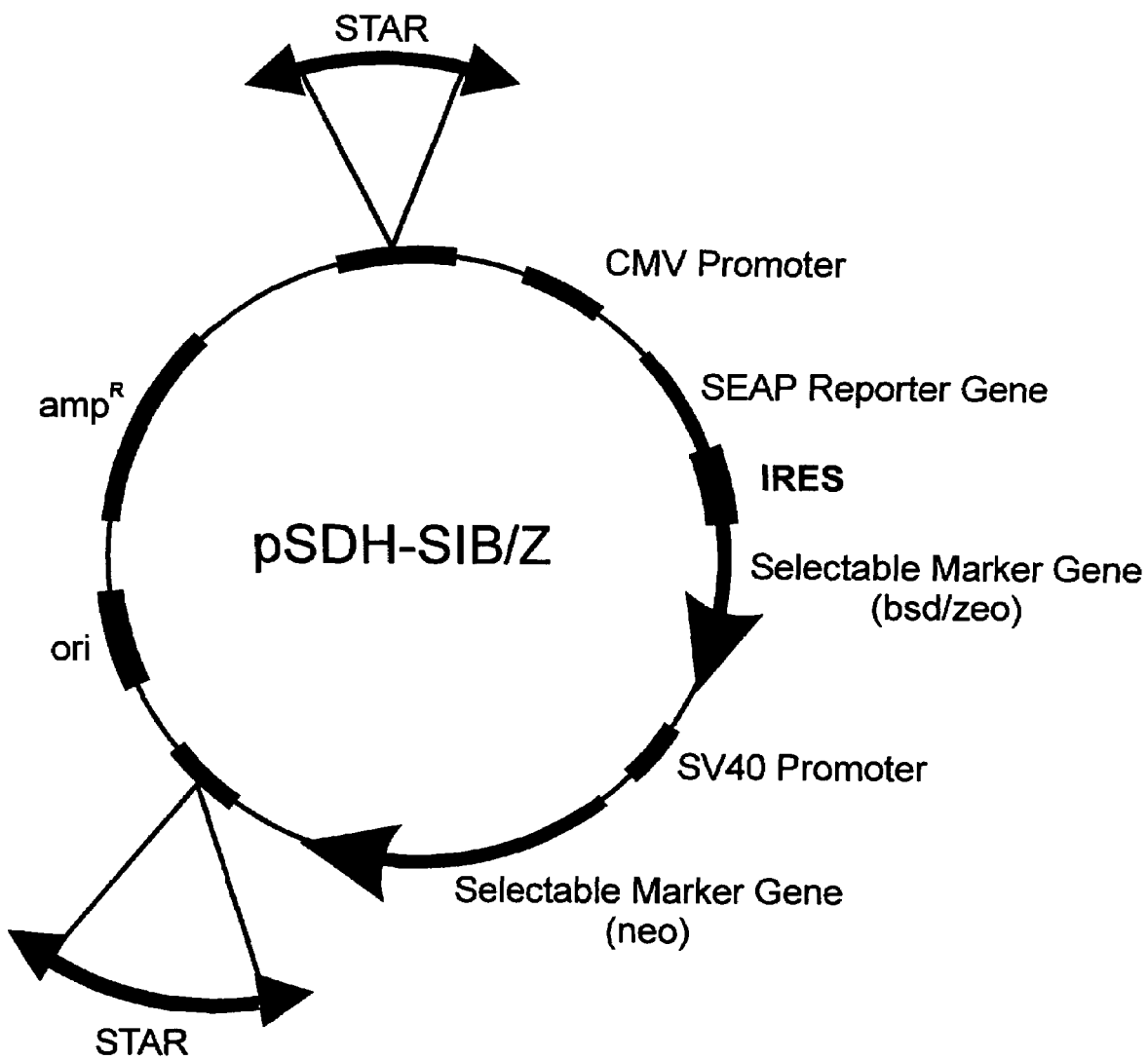
FIGS. 3A and 3B are diagrams of the pSDH-SIB/Z and pSDH-GIB/Z families of plasmids. These plasmids are derived from the pSDH-CSP plasmid (FIG. 2), by replacement of the monocistronic SEAP and puro genes with a bicistronic gene under control of the CMV promoter and a monocistronic neomycin resistance selectable marker gene (neo) under control of the SV40 promoter.
Figure 3B:
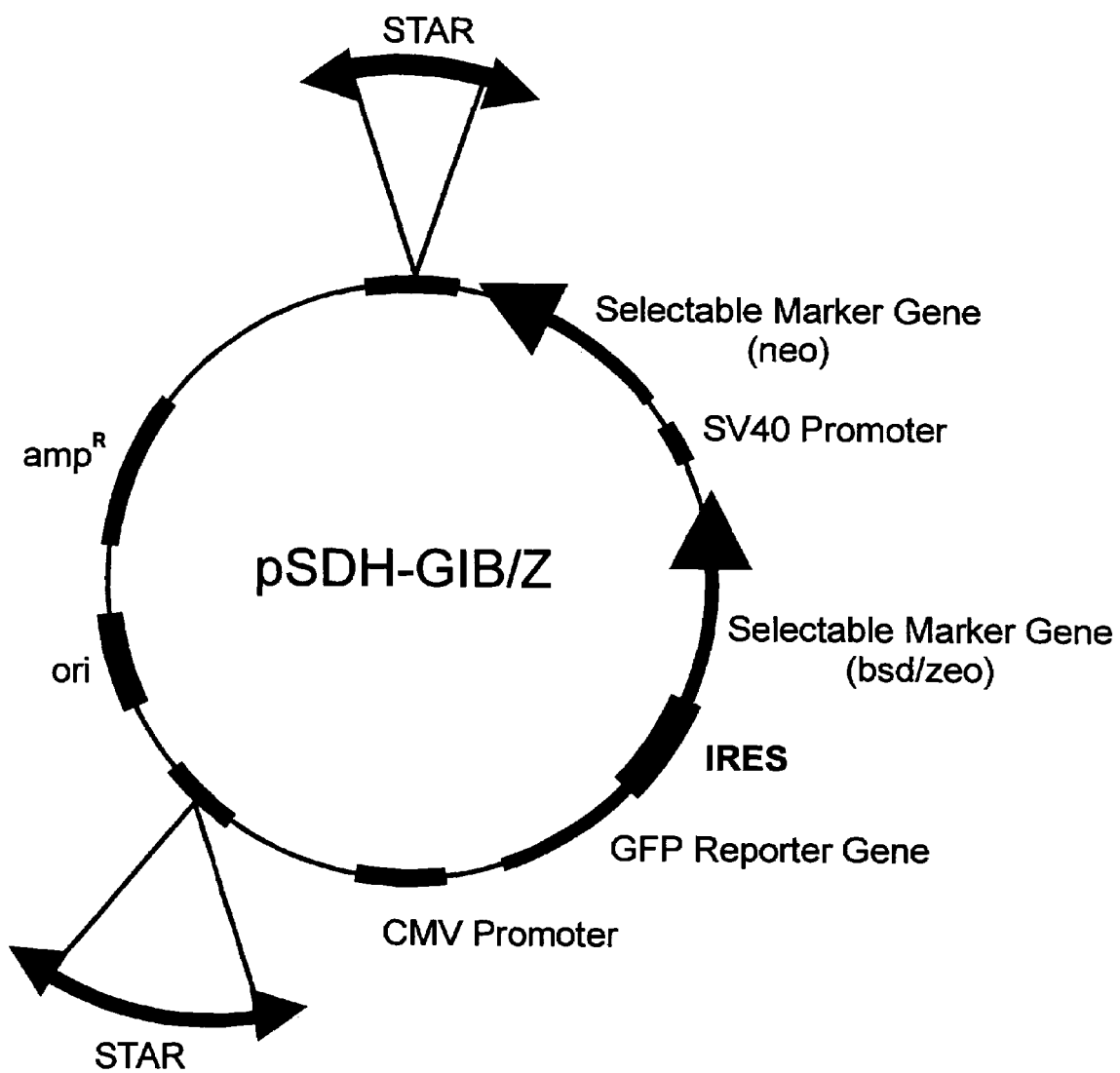

The pSDH-Tet vector was constructed by PCR of the luciferase open reading frame from plasmid pREP4-HSF-Luc (van der Vlag et al., 2000) using primers C67 and C68 (SEQ ID NOS:142 and 143, respectively), and insertion of the SacII/BamHI fragment into SacII/BamHI-digested pUHD10-3 (Gossen & Bujard, 1992). The luciferase expression unit was re-amplified with primers C65 and C66 (SEQ ID NOS:140 and 141, respectively), and re-inserted into pUHD10-3 in order to flank it with multiple cloning sites (MCSI and MCSII). An AscI site was then introduced into MCSI by digestion with EcoRI and insertion of a linker (comprised of annealed oligonucleotides D93 and D94, SEQ ID NOS:158 and 159, respectively). The CMV promoter was amplified from plasmid pCMV-Bsd with primers D90 and D91 (SEQ ID NOS:156 and 157, respectively), and used to replace the Tet-Off promoter in pSDH-Tet by SalI/SacII digestion and ligation to create vector pSDH-CMV. The luciferase open reading frame in this vector was replaced by SEAP as follows: vector pSDH-CMV was digested with SacII and BamHI and made blunt; the SEAP open reading frame was isolated from pSEAP-basic by EcoRI/SalI digestion, made blunt and ligated into pSDH-CMV to create vector pSDH-CS. The puromycin resistance gene under control of the SV40 promoter was isolated from plasmid pBabe-Puro (Morgenstern & Land, 1990) by PCR, using primers C81 and C82 (SEQ ID NOS:144 and 145, respectively). This was ligated into vector pGL3-control (BamHI site removed) (Promega E1741) digested with NcoI/XbaI, to create pGL3-puro. pGL3-puro was digested with BglII/SalI to isolate the SV40-puro resistance gene, which was made blunt and ligated into NheI digested, blunt-ended pSDH-CS. The resulting vector, pSDH-CSP, is shown in FIG. 2. STAR18 (SEQ ID NO:18) was inserted into MCSI and MCSII in two steps, by digestion of the STAR element and the pSDH-CSP vector with an appropriate restriction enzyme, followed by ligation. The orientation of the STAR element was determined by restriction mapping. The identity and orientation of the inserts were verified by DNA sequence analysis. Sequencing was performed by the dideoxy method (Sanger et al., 1977) using a Beckman CEQ2000 automated DNA sequencer, according to the manufacturer's instructions. Briefly, DNA was purified from E. coli using QIAprep® Spin Miniprep and Plasmid Midi Kits (QIAGEN® 27106 and 12145, respectively). Cycle sequencing was carried out using custom oligonucleotides C85, E25, and E42 (SEQ ID NOS:146, 173 and 174, respectively) (Table 1), in the presence of dye terminators CEQ™ Dye Terminator Cycle Sequencing Kit, Beckman 608000).

pSDH-CSP plasmids containing STAR elements were modified as follows: for receiving SEAP-IRES-zeo/bsd cassettes, an AgeI site was introduced at the BglII site by insertion of a linker, using oligonucleotides F32 and F33 (SEQ ID NOS:202 and 203, respectively); for receiving GFP-IRES-zeo/bsd cassettes, an AgeI site was introduced at the Bsu36I site by insertion of a linker, using oligonucleotides F44 and F45 (SEQ ID NOS:206 and 207, respectively). The SEAP-IRES-zeo/bsd cassettes were inserted into the pSDH-CSP-STAR18 plasmid by replacement of the Bsu36I/AgeI fragment with the corresponding fragments from the pIRES-SEAP-zeo/bsd plasmids. The GFP-IRES-zeo/bsd cassettes were inserted into pSDH-CSP-STAR plasmids by replacement of the BglII/AgeI fragment with the corresponding fragments from the pIRES-GFP-zeo/bsd plasmids. The resulting plasmid families, pSDH-SIB/Z and pSDH-GIB/Z, are shown in FIGS. 3A and 3B, respectively.

All cloning steps were carried out following the instructions provided by the manufacturers of the reagents used, according to methods known in the art (Sambrook et al., 1989).

Transfection and Culture of CHO Cells

The Chinese Hamster Ovary cell line CHO-K1 (ATCC CCL-61) was cultured in HAMS-F12 medium+10% Fetal Calf Serum containing 2 mM glutamine, 100 U/ml penicillin, and 100 micrograms/ml streptomcyin at 37° C., 5% $CO_2$. Cells were transfected with the pSDH-SIZ plasmids using SuperFect® (QIAGEN®) as described by the manufacturer. Briefly, cells were seeded to culture vessels and grown overnight to 70-90% confluence. SuperFect® reagent was combined with plasmid DNA at a ratio of 6 microliters per microgram (e.g., for a 10 cm Petri dish, 20 micrograms DNA and 120 microliters SuperFect®) and added to the cells. After overnight incubation the transfection mixture was replaced with fresh medium, and the transfected cells were incubated further. After overnight cultivation, cells were seeded into fresh culture vessels and 500 micrograms/ml neomycin was added. Neomycin selection was complete within three to four days. Fresh medium was then added containing zeocin (100 µg/ml) and cultured further. Individual clones were isolated after 4-5 days and cultured further. Expression of the reporter gene was assessed by measuring SEAP activity approximately three weeks after transfection.

Secreted Alkaline Phosphatase (SEAP) Assay

SEAP activity (Berger et al., 1988, Henthorn et al., 1988, Kain, 1997, Yang et al., 1997) in the culture media of the clones was determined as described by the manufacturer (Clontech Great EscAPe™ kit #K2041). Briefly, an aliquot of medium was heat inactivated at 65° C., then combined with assay buffer and CSPD chemiluminescent substrate and incubated at room temperature for ten minutes. The rate of substrate conversion was then determined in a luminometer (Turner 20/20TD). Cell density was determined by counting trypsinized cells in a Coulter ACT10 cell counter.

Results

Transfection of the pSDH-SIZ-STAR18 expression vector consistently results in ~10-fold more colonies than transfection of the empty pSDH-SIZ vector, presumably due to the increased proportion of primary transfectants that are able to bring the neomycin resistance gene to expression. The outcome of a typical experiment is shown in Table 2, in which transfection of the empty vector yielded ~100 G418-resistant colonies, and transfection of the STAR18 vector yielded ~1000 colonies.

The expression of the SEAP reporter transgene was compared between the empty pSDH-SIZ vector (hence, without a STAR sequence) and the STAR18 vector FIG. 4). The populations of G418-resistant isolates were divided into two sets. The first set was cultured with G418 only (one-step selection). For this set, the inclusion of STAR18 (SEQ ID NO:18) to protect the transgene from silencing resulted in higher yield of reporter protein: the maximal level of expression among the 20 clones analyzed was 2-3-fold higher than the maximal expression level of clones without the STAR element. The inclusion of STAR18 (SEQ ID NO:18) also led increased predictability: more than 25% of the STAR18 clones had expression levels greater than or equal to the maximum expression level observed in the STARless clones. In this population of STAR18 clones, 70% had expression above the background level, while only 50% of the STARless clones had expression above the background level.

The performance of STAR18 (SEQ ID NO:18) was even better when used in a two-step selection. The second set of G418-resistant isolates was treated with zeocin. Clones that survived the two-step selection regime were assayed for expression of the SEAP reporter transgene. In this case too, the STAR18 (SEQ ID NO:18) element increased the yield compared to the STARless clones by approximately threefold. The predictability was also increased by inclusion of STAR18 (SEQ ID NO:18): ~80% of the population had expression levels greater than the highest-expressing STARless clone.

When the one-step selection is compared with the two-step selection, it can be seen that the latter is superior in terms of both yield and predictability. In fact with two-step selection, no clones appear with background levels of expression. This is due to the requirement imposed on clones that survive zeocin selection that they have high levels of transcription of the bicistronic SEAP-zeocin gene. As indicated in Table 2, the elimination of low-producing clones by the second antibiotic selection step increases the predictability of finding high-producing clones; when STAR18 (SEQ ID NO:18) is included in the expression unit, this increased predictability is improved from three-fold to thirty-fold. In summary, when STAR elements are used in combination with two-step antibiotic selection, the predictability of finding clones with high yields of a transgene is dramatically improved. Application of this increased predictability to two or more transgenes simultaneously will significantly increase the likelihood of finding clones that have high yields of multimeric proteins.

Example 2

Simultaneous Expression of Two Proteins is Improved by Two-step Selection and STAR Elements A second object of this invention is to improve the expression of heterologous multimeric proteins such as antibodies. This example demonstrates that the combination of STAR elements and two-step antibiotic selection improves the predictability of establishing recombinant host cell lines that express balanced and proportional amounts of two heterologous polypeptides at high yields. This method of the invention is applicable in practice to multimeric proteins such as antibodies. It is demonstrated in this example using two reporter proteins, secreted alkaline phosphatase (SEAP) and green fluorescent protein (GFP).

Materials and Methods

Plasmids

The pSDH-SIB/Z and pSDH-GIB/Z families of plasmids described in Example 1 are used. Cloning of STAR elements x and y, transfection and culture of host cells, and SEAP assay are described in Example 1. The assay for GFP is performed according to the manufacturer's instructions.

Results

Results show an increased number of clones wherein the two reporter proteins are both expressed. Moreover, expression was balanced in many of such clones.

Example 3

General-purpose Vectors for Simultaneous Expression of Multiple Polypeptides

The expression system tested and validated in Example 1 has been modified to facilitate its application to any polypeptide that is preferably co-expressed with another polypeptide or polypeptides in a host cell, for example, the heavy and light chains of recombinant antibodies. It is designed for easy and rapid construction of the expression units. This improved system is described in this example.

Materials and Methods

Plasmids

The construction of the plasmids PP1 to PP5 is described below, and their map is shown in FIG. 5. Plasmid pd2EGFP (Clontech 6010-1) was modified by insertion of a linker at the BsiWI site to yield pd2EGFP-link. The linker (made by annealing oligonucleotides F25 and F26, SEQ ID NOS:200 and 201, respectively) introduces sites for the PacI, BglII, and EcoRV restriction endonucleases. This creates the multiple cloning site MCSII for insertion of STAR elements. Then primers F23 and F24 (SEQ ID NOS:198 and 199, respectively) were used to amplify a region of 0.37 kb from pd2EGFP, which was inserted into the BglII site of pIRES (Clontech 6028-1) to yield pIRES-stuf. This introduces sites for the AscI and SwaI restriction endonucleases at MCSI, and acts as a "stuffer fragment" to avoid potential interference between STAR elements and adjacent promoters. pIRES-stuf was digested with BglII and FspI to liberate a DNA fragment composed of the stuffer fragment, the CMV promoter, the IRES element (flanked by multiple cloning sites MCS A and MCS B), and the SV40 polyadenylation signal. This fragment was ligated with the vector backbone of pd2EGFP-link produced by digestion with BamHI and StuI, to yield pd2IRES-link.

The open reading frames of the zeocin-, neomycin-, or puromycin-resistance genes were inserted into the BamHI/NotI sites of MCS B in pd2IRES-link as follows: the zeocin-resistance ORF was amplified by PCR with primers F18 and E100 (SEQ ID NOS:193 and 187, respectively) from plasmid pEM7/zeo, digested with BamHI and NotI, and ligated with BamHI/NotI-digested pd2IRES-link to yield pd2IRES-link-zeo. The neomycin-resistance ORF was amplified by PCR with primers F19 and F20 (SEQ ID NOS:194 and 195, respectively) from pIRES, digested with BamHI and NotI, and ligated with BamHI/NotI-digested pd2IRES-link to yield pd2IRES-link-neo. The puromycin-resistance ORF was amplified by PCR with primers F21 and F22 (SEQ ID NOS:196 and 197, respectively) from plasmid pBabe-Puro (Morgenstern & Land, 1990), digested with BamHI and NotI, and ligated with BamHI/NotI-digested pd2IRES-link to yield pd2IRES-link-puro.

The GFP reporter ORF was introduced into pd2IRES-link-puro by amplification of phr-GFP-1 with primers F16 and F17 (SEQ ID NOS:191 and 192, respectively), and insertion of the EcoRI-digested GFP cassette into the EcoRI site in MCS A of the pd2IRES-link-puro plasmid, to yield plasmid PP1 (FIG. 5A). Correct orientation was verified by restriction mapping. The SEAP reporter ORF was introduced into pd2IRES-link-zeo and pd2IRES-link-neo by PCR amplification of pSEAP2-basic with primers F14 and F15 (SEQ ID NOS:189 and 190, respectively), and insertion of the EcoRI-digested SEAP cassette into the EcoRI sites in MCS A of the plasmids pd2IRES-link-zeo (to yield plasmid PP2, FIG. 5B) and pd2IRES-link-neo (to yield plasmid PP3, FIG. 5C). Correct orientation was verified by restriction mapping.

Plasmids PP1, PP2 and PP3 contain a bicistronic gene for expression of a reporter protein and an antibiotic resistance marker. In order to carry out two-step antibiotic selection with separate antibiotics, a monocistronic resistance marker was introduced as follows: pIRES-stuf was digested with ClaI, made blunt with Klenow enzyme, and digested further with BglII. This liberated a DNA fragment composed of the stuffer fragment, the CMV promoter, the IRES element (flanked by multiple cloning sites MCS A and MCS B), the SV40 polyadenylation signal, and the neomycin resistance marker under control of the SV40 promoter. This fragment was ligated with the vector backbone of pd2EGFP-link produced by digestion with BamHI and StuI, to yield pd2IRES-link-neo. Then as described above the GFP and puro cassettes were introduced to yield PP4 (FIG. 5D), and the SEAP and zeo cassettes were introduced to yield PP5 (FIG. 5E).

Example 4

Predictability and Yield are Improved by Application of STAR Elements in Expression Systems STAR elements function to block the effect of transcriptional repression influences on transgene expression units. These repression influences can be due to heterochromatin ("position effects" (Boivin & Dura, 1998)) or to adjacent copies of the transgene ("repeat-induced gene silencing" (Garrick et al., 1998)). Two of the benefits of STAR elements for protein production are increased predictability of finding high-expressing primary recombinant host cells, and increased yield during production cycles. These benefits are illustrated in this example.

Materials and Methods

Figure 6:
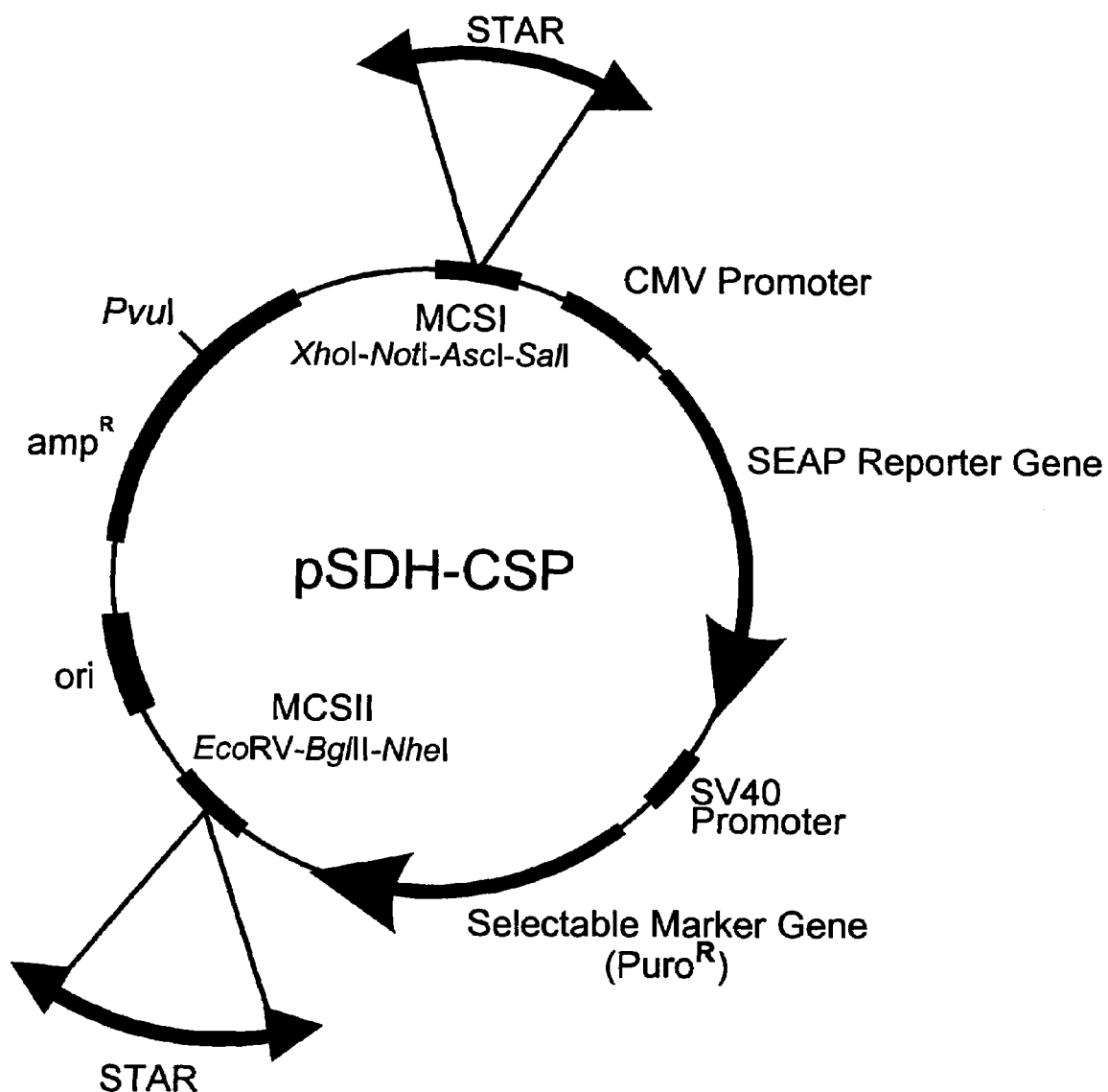
FIG. 6 is a diagram depicting the pSDH-CSP plasmid used for testing STAR activity. The Secreted Alkaline Phosphatase (SEAP) reporter gene is under control of the CMV promoter, and the puromycin resistance selectable marker (puro) is under control of the SV40 promoter. Flanking these two genes are multiple cloning sites into which STAR elements can be cloned. The plasmid also has an origin of replication (ori) and ampicillin resistance gene (ampR) for propagation in *Escherichia coli*.

Construction of the pSDH vectors and STAR-containing derivatives: The pSDH-Tet vector was constructed by polymerase chain reaction amplification (PCR) of the luciferase open reading frame from plasmid pREP4-HSF-Luc (van der Vlag et al., 2000) using primers C67 and C68 (SEQ ID NOS:142 and 143, respectively) (all PCR primers and mutagenic oligonucleotides are listed in Table 1), and insertion of the SacII/BamHI fragment into SacII/BamHI-digested pUHD10-3 (Gossen & Bujard, 1992). The luciferase expression unit was re-amplified with primers C65 and C66 (SEQ ID NOS:140 and 141, respectively), and re-inserted into pUHD10-3 in order to flank it with two multiple cloning sites (MCSI and MCSII). An AscI site was then introduced into MCSI by digestion with EcoRI and insertion of a linker (comprised of annealed oligonucleotides D93 and D94, SEQ ID NOS:158 and 159, respectively). The CMV promoter was amplified from plasmid pCMV-Bsd (Invitrogen K510-01) with primers D90 and D91 (SEQ ID NOS:156 and 157, respectively), and used to replace the Tet-Off promoter in pSDH-Tet by SalI/SacII digestion and ligation to create vector pSDH-CMV. The luciferase open reading frame in this vector was replaced by SEAP (Secreted Alkaline Phosphatase) as follows: vector pSDH-CMV was digested with SacII and BamHI and made blunt; the SEAP open reading frame was isolated from pSEAP-basic (Clontech 6037-1) by EcoRI/SalI digestion, made blunt and ligated into pSDH-CMV to create vector pSDH-CS. The puromycin resistance gene under control of the SV40 promoter was isolated from plasmid pBabe-Puro (Morgenstern & Land, 1990) by PCR, using primers C81 and C82 (SEQ ID NOS:144 and 145, respectively). This was ligated into vector pGL3-control (BamHI site removed) (Promega E1741) digested with NcoI/XbaI, to create pGL3-puro. pGL3-puro was digested with BglII/SalI to isolate the SV40-puro resistance gene, which was made blunt and ligated into NheI digested, blunt-ended pSDH-CS. The resulting vector, pSDH-CSP, is shown in FIG. 6. All cloning steps were carried out following the instructions provided by the manufacturers of the reagents, according to methods known in the art (Sambrook et al., 1989).

STAR elements were inserted into MCSI and MCSII in two steps, by digestion of the STAR element and the pSDH-CSP vector with an appropriate restriction enzyme, followed by ligation. The orientation of STAR elements in recombinant pSDH vectors was determined by restriction mapping. The identity and orientation of the inserts were verified by DNA sequence analysis. Sequencing was performed by the dideoxy method (Sanger et al., 1977) using a Beckman CEQ™ 2000 automated DNA sequencer, according to the manufacturer's instructions. Briefly, DNA was purified from *E. coli* using QIAprep® Spin Miniprep and Plasmid Midi Kits (QIAGEN® 27106 and 12145, respectively). Cycle sequencing was carried out using custom oligonucleotides C85, E25, and E42 (SEQ ID NOS:146, 173 and 174, respectively) (Table 1), in the presence of dye terminators (CEQ™ Dye Terminator Cycle Sequencing Kit, Beckman 608000).

Transfection and Culture of CHO Cells with pSDH Plasmids

The Chinese Hamster Ovary cell line CHO-K1 (ATCC CCL-61) was cultured in HAMS-F12 medium+10% Fetal Calf Serum containing 2 mM glutamine, 100 U/ml penicillin, and 100 micrograms/ml streptomcyin at 37° C., 5% $CO_2$. Cells were transfected with the pSDH-CSP vector, and its derivatives containing STAR6 (SEQ ID NO:6) or STAR49 (SEQ ID NO:49) in MCSI and MCSII, using SuperFect® (QIAGEN®) as described by the manufacturer. Briefly, cells were seeded to culture vessels and grown overnight to 70-90% confluence. SuperFect® reagent was combined with plasmid DNA (linearized in this example by digestion with PvuI) at a ratio of 6 microliters per microgram (e.g., for a 10 cm Petri dish, 20 micrograms DNA and 120 microliters SuperFect®) and added to the cells. After overnight incubation the transfection mixture was replaced with fresh medium, and the transfected cells were incubated further. After overnight cultivation, 5 micrograms/ml puromycin was added. Puromycin selection was complete in two weeks, after which time individual puromycin resistant CHO/pSDH-CSP clones were isolated at random and cultured further.

Secreted Alkaline Phosphatase (SEAP) Assay

SEAP activity (Berger et al., 1988, Henthorn et al., 1988, Kain, 1997, Yang et al., 1997) in the culture medium of CHO/pSDH-CSP clones was determined as described by the manufacturer (Clontech Great EscAPe™ kit #K2041). Briefly, an aliquot of medium was heat inactivated at 65° C., then combined with assay buffer and CSPD chemiluminescent substrate and incubated at room temperature for ten minutes. The rate of substrate conversion was then determined in a luminometer (Turner 20/20TD). Cell density was determined by counting trypsinized cells in a Coulter ACT10 cell counter.

Transfection and Culture of U-2 OS Cells with pSDH Plasmids

The human osteosarcoma U-2 OS cell line (ATCC #HTB-96) was cultured in Dulbecco's Modified Eagle Medium+10% Fetal Calf Serum containing glutamine, penicillin, and streptomycin (supra) at 37° C., 5% $CO_2$. Cells were co-transfected with the pSDH-CMV vector, and its derivatives containing STAR6 (SEQ ID NO:6) or STAR8 (SEQ ID NO:8) in MCSI and MCSII, (along with plasmid pBabe-Puro) using SuperFect® (supra). Puromycin selection was complete in two weeks, after which time individual puromycin resistant U-2 OS/pSDH-CMV clones were isolated at random and cultured further.

Luciferase Assay

Luciferase activity (Himes & Shannon, 2000) was assayed in resuspended cells according to the instructions of the assay kit manufacturer (Roche 1669893), using a luminometer (Turner 20/20TD). Total cellular protein concentration was determined by the bicinchoninic acid method according to the manufacturer's instructions (Sigma B-9643), and used to normalize the luciferase data.

Results

Figure 7:
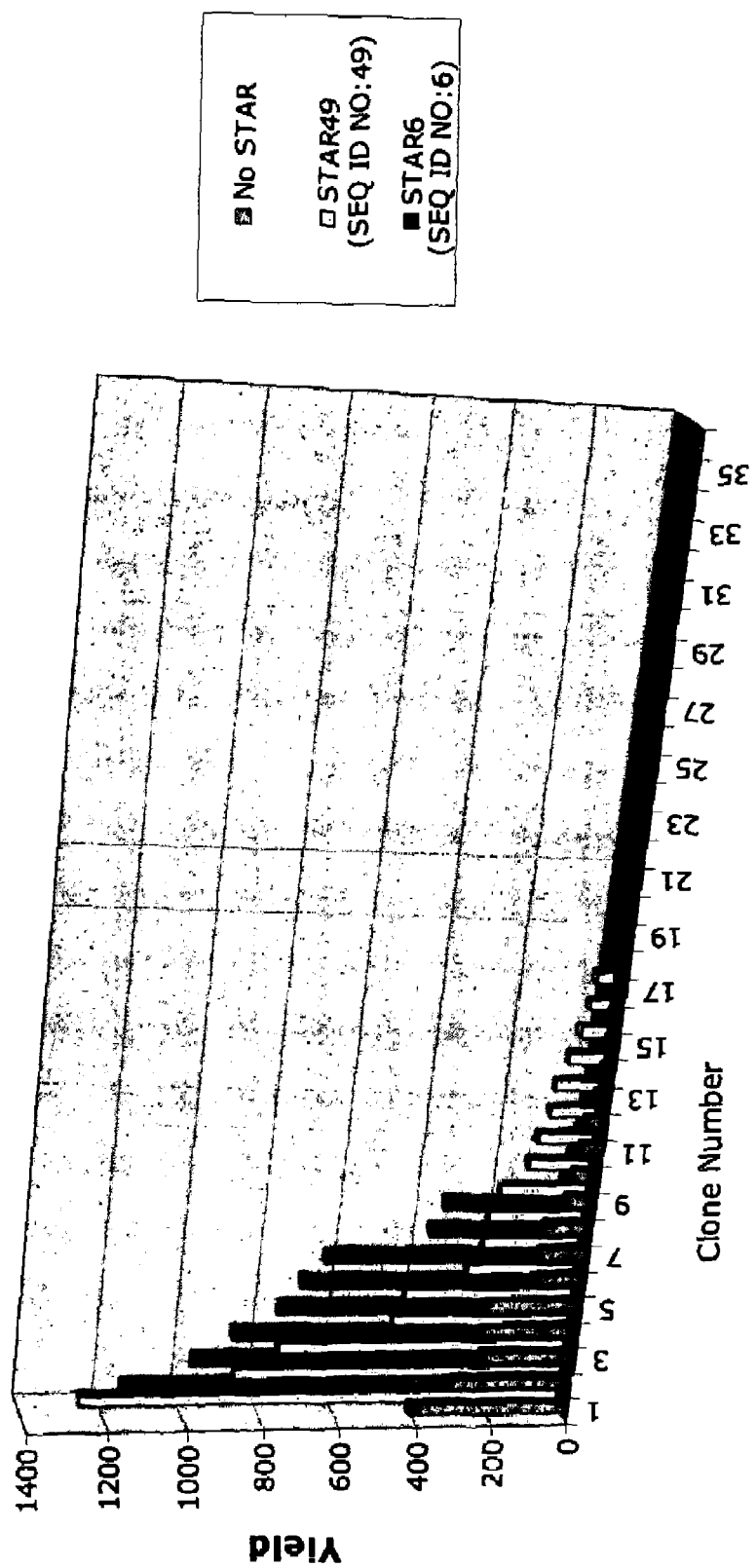
FIG. 7 is a graph illustrating that STAR6 (SEQ ID NO:6) and STAR49 (SEQ ID NO:49) improve predictability and yield of transgene expression. Expression of SEAP from the CMV promoter by CHO cells transfected with pSDH-CSP, pSDH-CSP-STAR6, or pSDH-CSP-STAR49 was determined. The STAR-containing constructs confer greater predictability and elevated yield relative to the pSDH-CSP construct alone.

Recombinant CHO cell clones containing the pSDH-CSP vector, or pSDH-CSP plasmids containing STAR6 (SEQ ID NO:6) or STAR49 (SEQ ID NO:49) (Table 6), were cultured for three weeks. The SEAP activity in the culture supernatants was then determined, and is expressed on the basis of cell number (FIG. 7). As can be seen, clones with STAR elements in the expression units were isolated that express 2-3 fold higher SEAP activity than clones whose expression units do not include STAR elements. Furthermore, the number of STAR-containing clones that express SEAP activity at or above the maximal activity of the STAR-less clones is quite high: 25% to 40% of the STAR clone populations exceed the highest SEAP expression of the pSDH-CSP clones.

Recombinant U-2 OS cell clones containing the pSDH-CMV vector, or pSDH-CMV plasmids containing STAR6 (SEQ ID NO:6) or STAR8 (SEQ ID NO:8) (Table 6), were cultured for three weeks. The luciferase activity in the host cells was then determined, and is expressed as relative luciferase units (FIG. 8), normalized to total cell protein. The recombinant U-2 OS clones with STAR elements flanking the expression units had higher yields than the STAR-less clones: the highest expression observed from STAR8 clones was 2-3 fold higher than the expression from STAR-less clones. STAR6 clones had maximal expression levels five-fold higher than the STAR-less clones. The STAR elements conferred greater predictability as well: for both STAR elements, 15 to 20% of the clones displayed luciferase expression at levels comparable to or greater than the STAR-less clone with the highest expression level.

These results demonstrate that, when used with the strong CMV promoter, STAR elements increase the yield of heterologous proteins (luciferase and SEAP). All three of the STAR elements introduced in this example provide elevated yields. The increased predictability conferred by the STAR elements is manifested by the large proportion of the clones with yields equal to or greater than the highest yields displayed by the STAR-less clones.

Example 5

STAR Elements Improve the Stability of Transgene Expression

During cultivation of recombinant host cells, it is common practice to maintain antibiotic selection. This is intended to prevent transcriptional silencing of the transgene, or loss of the transgene from the genome by processes such as recombination. However it is undesirable for production of proteins, for a number of reasons. First, the antibiotics that are used are quite expensive, and contribute significantly to the unit cost of the product. Second, for biopharmaceutical use, the protein must be demonstrably pure, with no traces of the antibiotic in the product. One advantage of STAR elements for heterologous protein production is that they confer stable expression on transgenes during prolonged cultivation, even in the absence of antibiotic selection; this property is demonstrated in this example.

Materials and Methods

The U-2 OS cell line was transfected with the plasmid pSDH-Tet-STAR6 and cultivated as described in Example 4. Individual puromycin-resistant clones were isolated and cultivated further in the absence of doxycycline. At weekly intervals the cells were transferred to fresh culture vessels at a dilution of 1:20. Luciferase activity was measured at periodic intervals as described in Example 4. After 15 weeks the cultures were divided into two replicates; one replicate continued to receive puromycin, while the other replicate received no antibiotic for the remainder of the experiment (25 weeks total).

Results

Table 7 presents the data on luciferase expression by an expression unit flanked with STAR6 (SEQ ID NO:6) during prolonged growth with or without antibiotic. As can be seen, the expression of the reporter transgene, luciferase, remains stable in the U-2 OS host cells for the duration of the experiment. After the cultures were divided into two treatments (plus antibiotic and without antibiotic) the expression of luciferase was essentially stable in the absence of antibiotic selection. This demonstrates the ability of STAR elements to protect transgenes from silencing or loss during prolonged cultivation. It also demonstrates that this property is independent of antibiotic selection. Therefore, production of proteins is possible without incurring the costs of the antibiotic or of difficult downstream processing.

Example 6

Minimal Essential Sequences of STAR Elements

STAR elements are isolated from the genetic screen as described herein. The screen uses libraries constructed with human genomic DNA that was size-fractionated to approximately 0.5-2 kilobases (supra). The STAR elements range from 500 to 2361 base pairs (Table 6). It is likely that, for many of the STAR elements that have been isolated, STAR activity is conferred by a smaller DNA fragment than the initially isolated clone. It is useful to determine these minimum fragment sizes that are essential for STAR activity, for two reasons. First, smaller functional STAR elements would be advantageous in the design of compact expression vectors, since smaller vectors transfect host cells with higher efficiency. Second, determining minimum essential STAR sequences permits the modification of those sequences for enhanced functionality. Two STAR elements have been fine-mapped to determine their minimal essential sequences.

Figure 9:
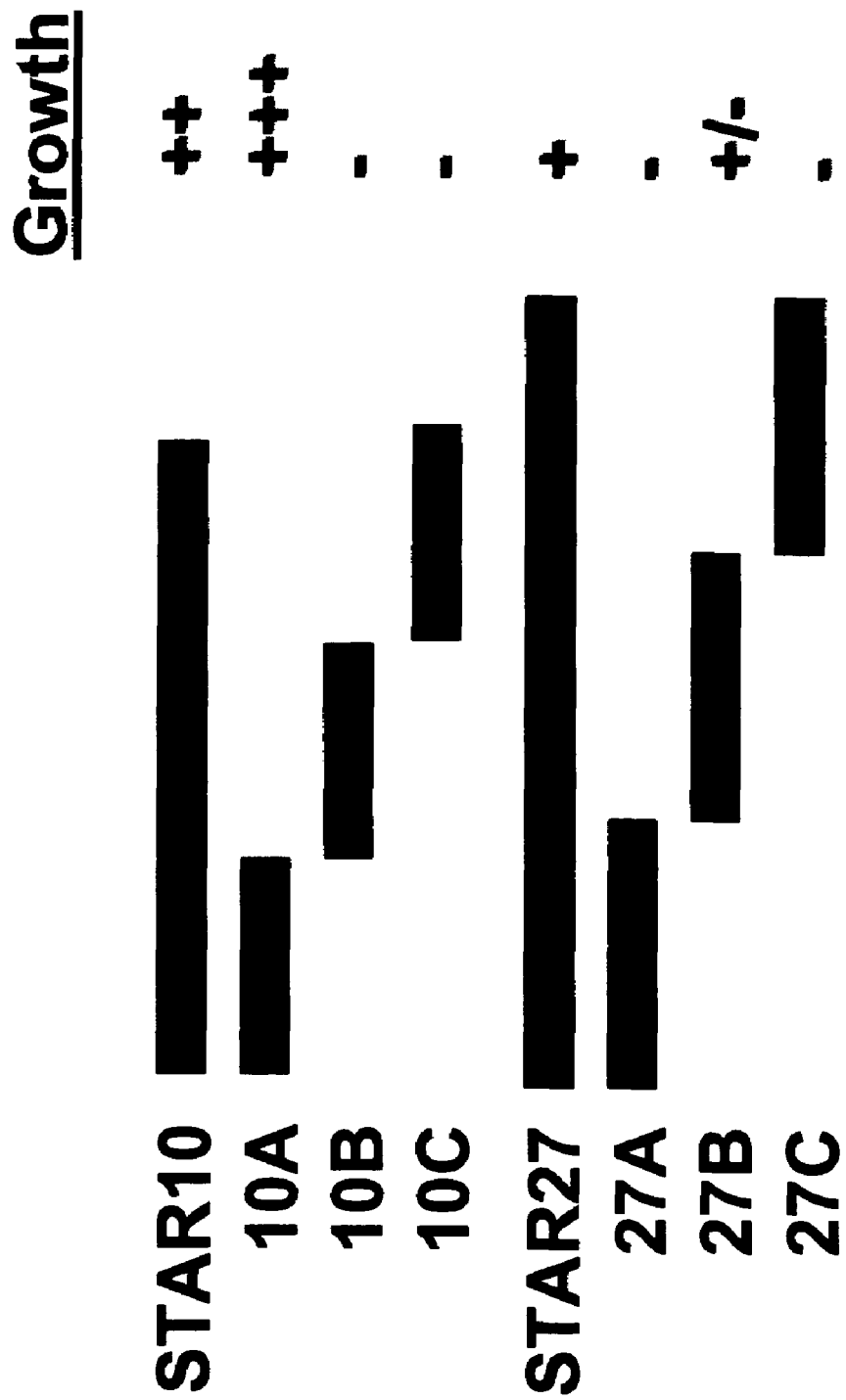
FIG. 9 is a graph showing the minimal essential sequences of STAR10 (SEQ ID NO:10) and STAR27 (SEQ ID NO:27). Portions of the STAR elements were amplified by PCR: STAR10 (SEQ ID NO:10) was amplified with primers E23 (SEQ ID NO:172) and E12 (SEQ ID NO:161) to yield fragment 10A, E13 (SEQ ID NO:162) and E14 (SEQ ID NO:163) to yield fragment 10B, and E15 (SEQ ID NO:164) and E16 (SEQ ID NO:165) to yield fragment 10C. STAR27 (SEQ ID NO:27) was amplified with primers E17 (SEQ ID NO:166) and E18 (SEQ ID NO:167) to yield fragment 27A, E19 (SEQ ID NO:168) and E20 (SEQ ID NO:169) to yield fragment 27B, and E21 (SEQ ID NO:170) and E22 (SEQ ID NO:171) to yield fragment 27C. These sub-fragments were cloned into the pSelect vector. After transfection into U-2 OS/Tet-Off/LexA-HP1 cells, the growth of the cultures in the presence of zeocin was monitored. Growth rates varied from vigorous (+++) to poor (+/−), while some cultures failed to survive zeocin treatment (−) due to absence of STAR activity in the DNA fragment tested.

Materials and Methods:

STAR10 (SEQ ID NO:10) (1167 base pairs) and STAR27 (SEQ ID NO:27) (1520 base pairs) have been fine-mapped. They have been amplified by PCR to yield sub-fragments of approximately equal length (FIG. 9 legend). For initial testing, these have been cloned into the pSelect vector at the BamHI site, and transfected into U-2 OS/Tet-Off/LexA-HP1 cells. The construction of the host strains has been described (van der Vlag et al., 2000). Briefly, they are based on the U-2 OS human osteosarcoma cell line (American Type Culture Collection HTB-96). U-2 OS is stably transfected with the pTet-Off plasmid (Clontech K1620-A), encoding a protein chimera consisting of the Tet-repressor DNA binding domain and the VP16 transactivation domain. The cell line is subsequently stably transfected with fusion protein genes containing the LexA DNA binding domain, and the coding regions of either HP1 or HPC2 (two *Drosophila* Polycomb group proteins that repress gene expression when tethered to DNA). The LexA-repressor genes are under control of the Tet-Off transcriptional regulatory system (Gossen and Bujard, 1992). After selection for hygromycin resistance, LexA-HP1 was induced by lowering the doxycycline concentration. Transfected cells were then incubated with zeocin to test the ability of the STAR fragments to protect the SV40-Zeo expression unit from repression due to LexA-HP1 binding.

Results

In this experiment STAR10 (SEQ ID NO:10) and STAR27 (SEQ ID NO:27) confer good protection against gene silencing, as expected (FIG. 9). This is manifested by robust growth in the presence of zeocin.

Of the three STAR10 (SEQ ID NO:10) sub-fragments, 10A (corresponding in sequence to roughly the first 400 nucleotides of SEQ ID NO:10) (~400 base pairs) confers on transfected cells vigorous growth in the presence of zeocin, exceeding that of the full-length STAR element. Cells transfected with pSelect constructs containing the other two sub-fragments do not grow in the presence of zeocin. These results identify the ~400 base pair 10A fragment as encompassing the DNA sequence responsible for the anti-repression activity of STAR10 (SEQ ID NO:10).

STAR27 (SEQ ID NO:27) confers moderate growth in zeocin to transfected cells in this experiment (FIG. 9). One of the sub-fragments of this STAR, 27B (corresponding in sequence to roughly the second 500 nucleotides of SEQ ID NO:27) (~500 base pairs), permits weak growth of the host cells in zeocin-containing medium. This suggests that the anti-repression activity of this STAR is partially localized on sub-fragment 27B (corresponding in sequence to roughly the first 500 nucleotides of SEQ ID NO:27), but full activity requires sequences from 27A (corresponding in sequence to roughly the first 500 nucleotides of SEQ ID NO:27) and/or 27C (corresponding in sequence to roughly the third 500 nucleotides of SEQ ID NO:27) (each ~500 base pairs) as well.

Example 7

STAR Elements Function in Diverse Strains of Cultured Mammalian Cells

The choice of host cell line for (heterologous) protein expression is a critical parameter for the quality, yield, and unit cost of the protein. Considerations such as post-translational modifications, secretory pathway capacity, and cell line immortality dictate the appropriate cell line for a particular biopharmaceutical production system. For this reason, the advantages provided by STAR elements in terms of yield, predictability, and stability should be obtainable in diverse cell lines. This was tested by comparing the function of STAR6 (SEQ ID NO:6) in the human U-2 OS cell line in which it was originally cloned, and the CHO cell line which is widely applied in biotechnology.

Materials and Methods:

The experiments of Example 4 are referred to.

Results

Figure 8:
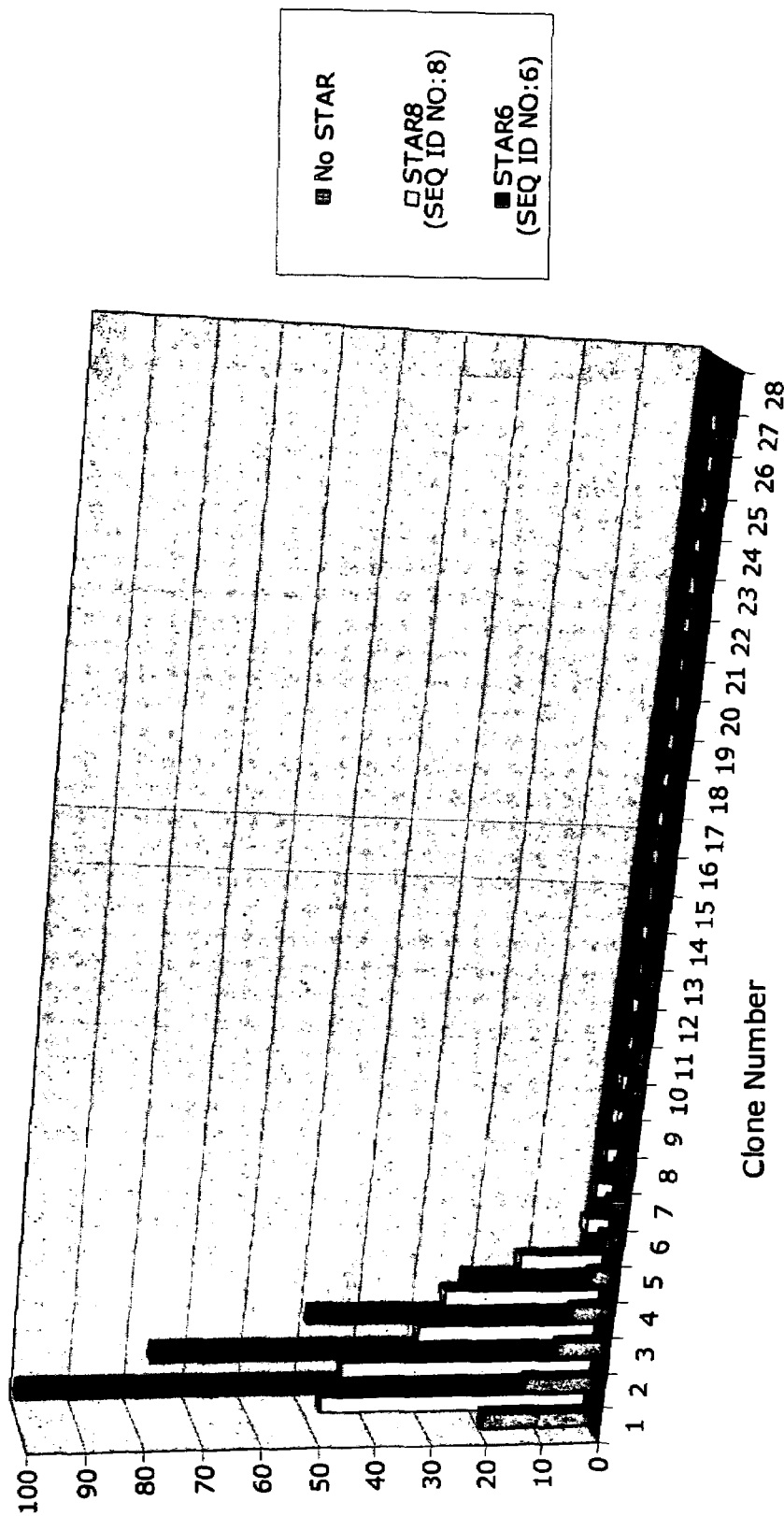
FIG. 8 is a graph illustrating that STAR6 (SEQ ID NO:6) and STAR8 (SEQ ID NO:8) improve predictability and yield of transgene expression. Expression of luciferase from the CMV promoter by U-2 OS cells transfected with pSDH-CMV, pSDH-CMV-STAR6, or pSDH-CMV-STAR8 was determined. The STAR-containing constructs confer greater predictability and elevated yield relative to the pSDH-CMV construct alone.

The expression of the SEAP reporter gene in CHO cells is presented in FIG. 7; the expression of the luciferase reporter gene in U-2 OS cells is presented in FIG. 8. By comparison of the results of these two experiments, it is apparent that the STAR6 (SEQ ID NO:6) element is functional in both cell lines: reporter gene expression was more predictable in both of them, and clones of each cell line displayed higher yields, when the reporter gene was shielded from position effects by STAR6 (SEQ ID NO:6). These two cell lines are derived from different species (human and hamster) and different tissue types (bone and ovary), reflecting the broad range of host cells in which this STAR element can be utilized in improving heterologous protein expression.

Example 8

STAR Elements Function in the Context of Various Transcriptional Promoters

Transgene transcription is achieved by placing the transgene open reading frame under control of an exogenous promoter. The choice of promoter is influenced by the nature of the (heterologous) protein and the production system. In most cases, strong constitutive promoters are preferred because of the high yields they can provide. Some viral promoters have these properties; the promoter/enhancer of the cytomegalovirus immediate early gene ("CMV promoter") is generally regarded as the strongest promoter in common biotechnological use (Boshart et al., 1985, Doll et al., 1996, Foecking & Hofstetter, 1986). The simian virus SV40 promoter is also moderately strong (Boshart et al., 1985, Foecking & Hofstetter, 1986) and is frequently used for ectopic expression in mammalian cell vectors. The Tet-Off promoter is inducible: the promoter is repressed in the presence of tetracycline or related antibiotics (doxycycline is commonly used) in cell-lines which express the tTA plasmid (Clontech K1620-A), and removal of the antibiotic results in transcriptional induction (Deuschle et al., 1995, Gossen & Bujard, 1992, Izumi & Gilbert, 1999, Umana et al., 1999).

Materials and Methods:

The construction of the pSDH-Tet and pSDH-CMV vectors is described in Example 4. pSDH-SV40 is, amongst others, derived from pSelect-SV40-zeo. The selection vector for STAR elements, pSelect-SV40-zeo is constructed as follows: the pREP4 vector (Invitrogen V004-50) is used as the plasmid backbone. It provides the Epstein Barr oriP origin of replication and EBNA-1 nuclear antigen for high-copy episomal replication in primate cell lines; the hygromycin resistance gene with the thymidine kinase promoter and polyadenylation site, for selection in mammalian cells; and the ampicillin resistance gene and colE1 origin of replication for maintenance in *Escherichia coli*. The vector contains four consecutive LexA operator sites between XbaI and NheI restriction sites (Bunker and Kingston, 1994). Embedded between the LexA operators and the NheI site is a polylinker consisting of the following restriction sites: HindIII-AscI-BamHI-AscI-HindIII. Between the NheI site and a SalI site is the zeocin resistance gene with the SV40 promoter and polyadenylation site, derived from pSV40/Zeo (Invitrogen V502-20); this is the selectable marker for the STAR screen.

pSDH-SV40 was constructed by PCR amplification of the SV40 promoter (primers D41 and D42) from plasmid pSelect-SV40-Zeo, followed by digestion of the PCR product with SacII and SalI. The pSDH-CMV vector was digested with SacII and SalI to remove the CMV promoter, and the vector and SV40 fragment were ligated together to create pSDH-SV40. STAR6 (SEQ ID NO:6) was cloned into MCSI and MCSII as described in Example 4. The plasmids pSDH-Tet, pSDH-Tet-STAR6, pSDH-Tet-STAR7, pSDH-SV40 and pSDH-SV40-STAR6 were co-transfected with pBabe-Puro into U-2 OS using SuperFect as described by the manufacturer. Cell cultivation, puromycin selection, and luciferase assays were carried out as described in Example 4.

Results

Figure 10:
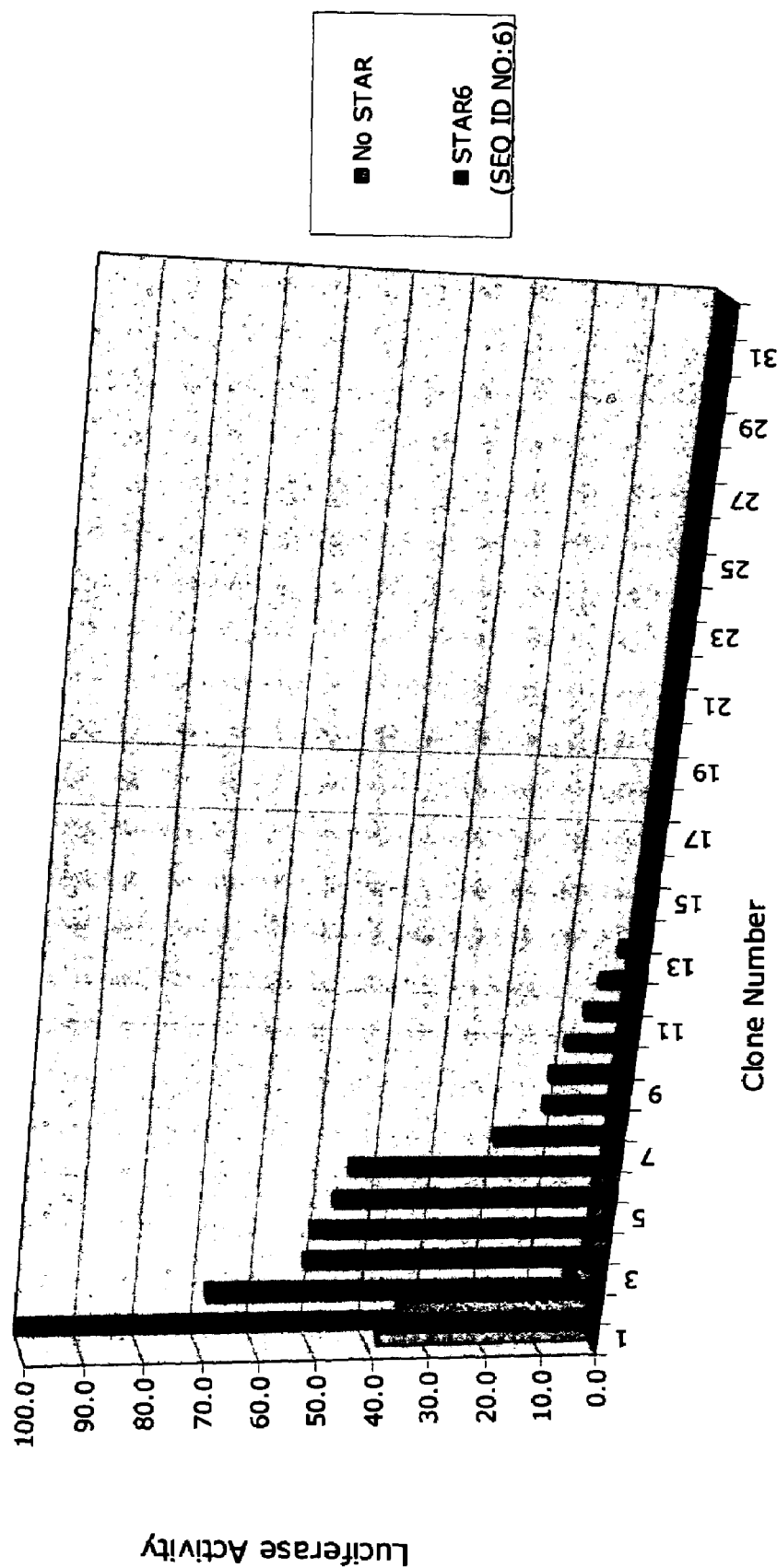
FIG. 10 is a graph showing STAR element function in the context of the SV40 promoter. pSDH-SV40 and pSDH-SV40-STAR6 were transfected into the human osteosarcoma U-2 OS cell line, and expression of luciferase was assayed with or without protection from gene silencing by STAR6 (SEQ ID NO:6) in puromycin-resistant clones.
Figure 11:
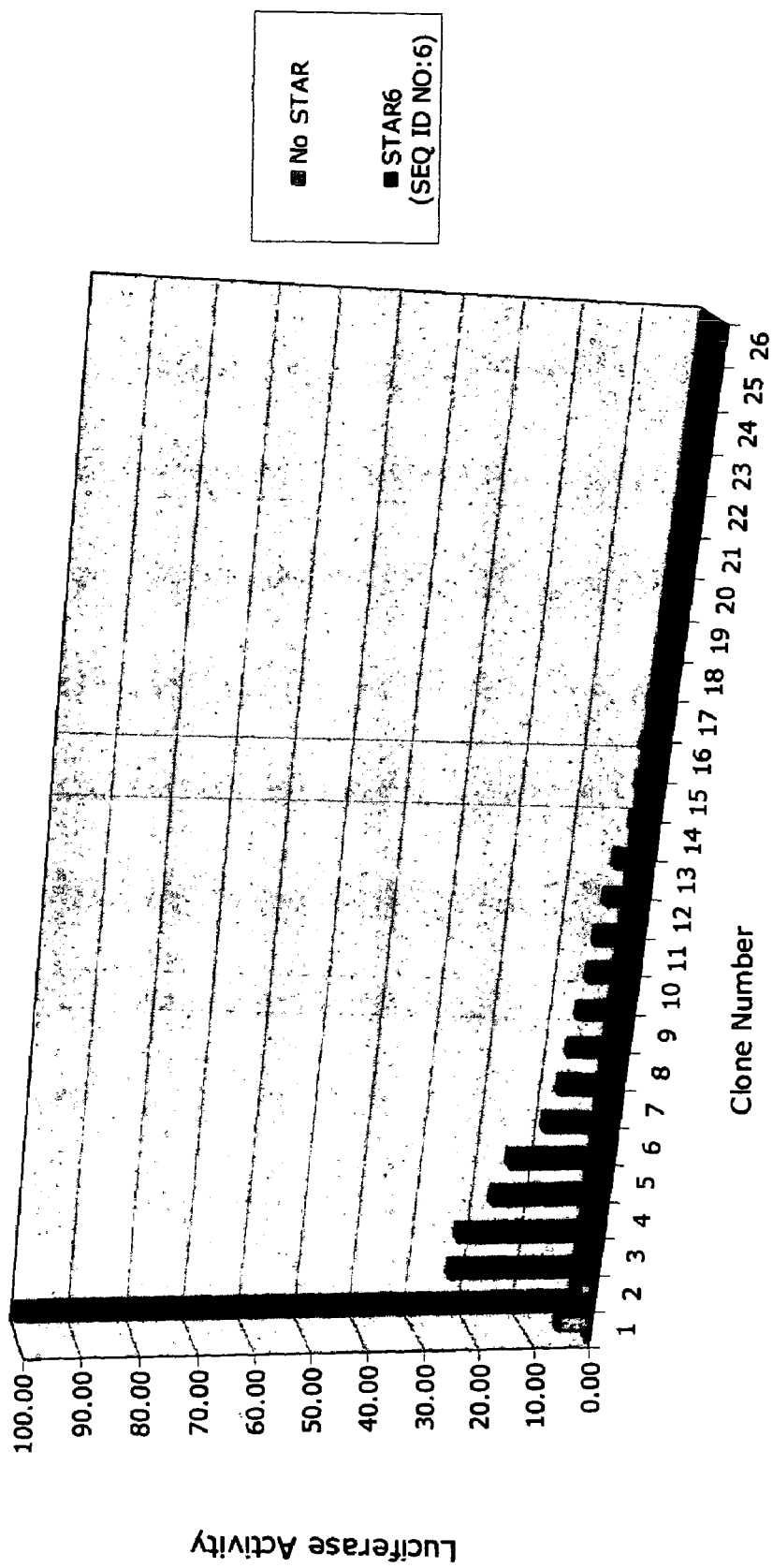
FIG. 11 is a graph illustrating STAR element function in the context of the Tet-Off promoter. pSDH-Tet and pSDH-Tet-STAR6 were transfected into the human osteosarcoma U-2 OS cell line, and expression of luciferase was assayed with or without protection from gene silencing by STAR6 (SEQ ID NO:6) in puromycin-resistant clones.

FIGS. 9, 11, and 12 compare the expression of the luciferase reporter gene from three different promoters: two strong and constitutive viral promoters (CMV and SV40), and the inducible Tet-Off promoter. All three promoters were tested in the context of the STAR6 (SEQ ID NO:6) element in U-2 OS cells. The results demonstrate that the yield and predictability from all three promoters are increased by STAR6 (SEQ ID NO:6). As described in Examples 4 and 7, STAR6 (SEQ ID NO:6) is beneficial in the context of the CMV promoter (FIG. 8). Similar improvements are seen in the context of the SV40 promoter (FIG. 10): the yield from the highest-expressing STAR6 clone is 2-3 fold greater than the best pSDH-SV40 clones, and six STAR clones (20% of the population) have yields higher than the best STAR-less clones. In the context of the Tet-Off promoter under inducing (low doxycycline) concentrations, STAR6 (SEQ ID NO:6) also improves the yield and predictability of transgene expression (FIG. 11): the highest-expressing STAR6 clone has a 20-fold higher yield than the best pSDH-Tet clone, and nine STAR6 clones (35% of the population) have yields higher than the best STAR-less clone. It is concluded that this STAR element is versatile in its transgene-protecting properties, since it functions in the context of various biotechnologically useful promoters of transcription.

Example 9

STAR Element Function can be Directional

While short nucleic acid sequences can be symmetrical (e.g., palindromic), longer naturally-occurring sequences are typically asymmetrical. As a result, the information content of nucleic acid sequences is directional, and the sequences themselves can be described with respect to their 5' and 3' ends. The directionality of nucleic acid sequence information affects the arrangement in which recombinant DNA molecules are assembled using standard cloning techniques known in the art (Sambrook et al., 1989). STAR elements are long, asymmetrical DNA sequences, and have a directionality based on the orientation in which they were originally cloned in the pSelect vector. In the examples given above, using two STAR elements in pSDH vectors, this directionality was preserved. This orientation is described as the native or 5'-3' orientation, relative to the zeocin resistance gene (see FIG. 12). In this example, the importance of directionality for STAR function is tested in the pSDH-Tet vector. Since the reporter genes in the pSDH vectors are flanked on both sides by copies of the STAR element of interest, the orientation of each STAR copy must be considered. This example compares the native orientation with the opposite orientation (FIG. 12).

Materials and Methods:

The STAR66 (SEQ ID NO:66) element was cloned into pSDH-Tet as described in Example 4. U-2 OS cells were co-transfected with plasmids pSDH-Tet-STAR66-native and pSDH-Tet-STAR66-opposite, and cultivated as described in Example 4. Individual clones were isolated and cultivated; the level of luciferase expression was determined as described (supra).

Results

Figure 13:
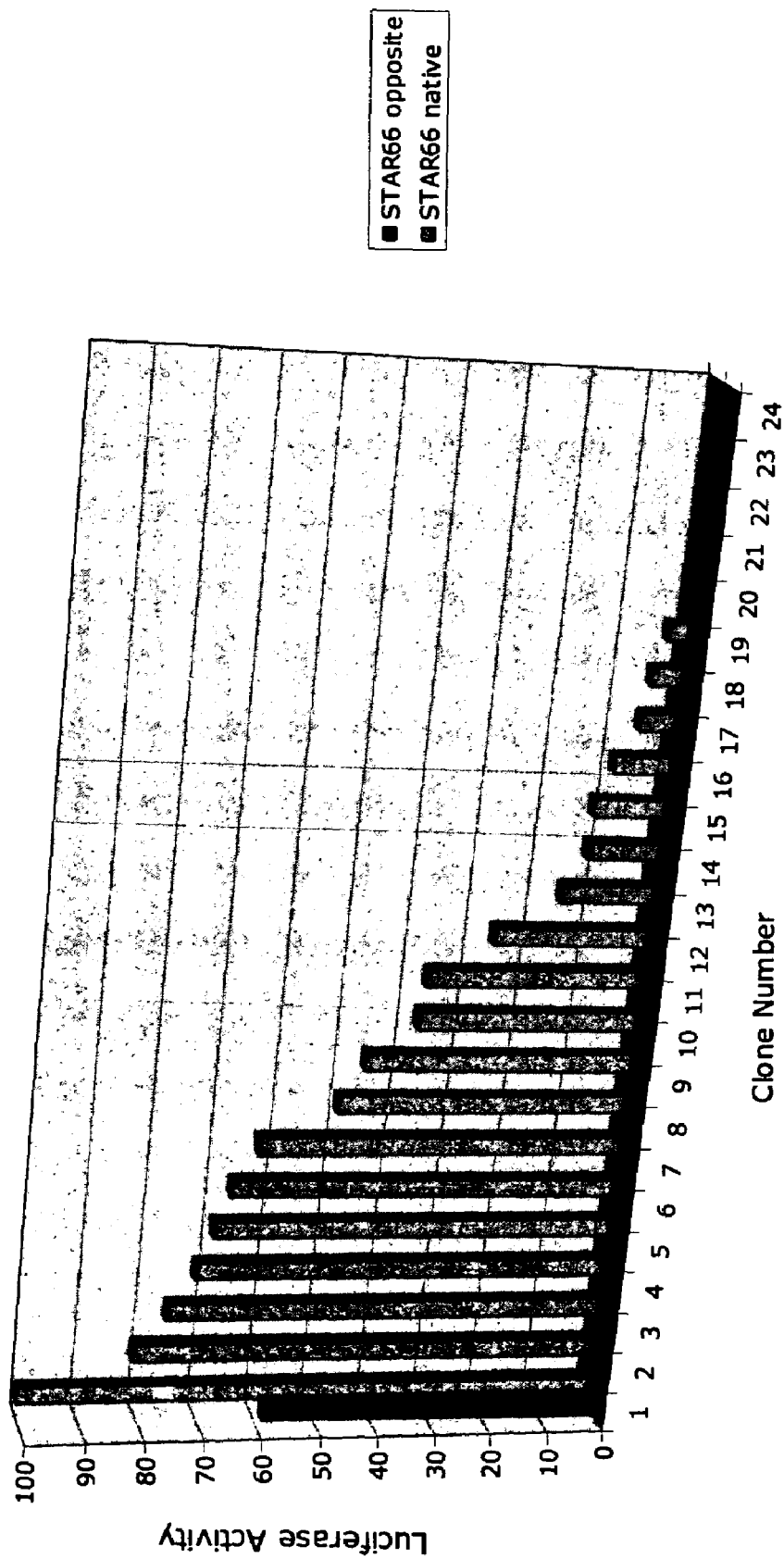
FIG. 13 is a graph showing directionality of STAR66 (SEQ ID NO:66) function. The STAR66 element (SEQ ID NO:66) was cloned into pSDH-Tet in either the native (STAR66 native) or the opposite orientation (STAR66 opposite), and transfected into U-2 OS cells. Luciferase activity was assayed in puromycin resistant clones.

The results of the comparison of STAR66 (SEQ ID NO:66) activity in the native orientation and the opposite orientation are shown in FIG. 13. When STAR66 (SEQ ID NO:66) is in the opposite orientation, the yield of only one clone is reasonably high (60 luciferase units). In contrast, the yield of the highest-expressing clone when STAR66 (SEQ ID NO:66) is in the native orientation is considerably higher (100 luciferase units), and the predictability is much higher as well: seven clones of the native-orientation population (30%) express luciferase above the level of the highest-expressing clone from the opposite-orientation population, and 15 of the clones in the native-orientation population (60%) express luciferase above ten relative luciferase units.

Therefore, it is demonstrated that STAR66 (SEQ ID NO:66) function is directional.

Example 10

Transgene Expression in the Context of STAR Elements is Copy Number-dependent

Transgene expression units for (heterologous) protein expression are generally integrated into the genome of the host cell to ensure stable retention during cell division. Integration can result in one or multiple copies of the expression unit being inserted into the genome; multiple copies may or may not be present as tandem arrays. The increased yield demonstrated for transgenes protected by STAR elements (supra) suggests that STAR elements are able to permit the transgene expression units to function independently of influences on transcription associated with the site of integration in the genome (independence from position effects (Boivin & Dura, 1998). It suggests further that the STAR elements permit each expression unit to function independently of neighboring copies of the expression unit when they are integrated as a tandem array (independence from repeat-induced gene silencing (Garrick et al., 1998)). Copy number-dependence is determined from the relationship between transgene expression levels and copy number, as described in the example below.

Figure 14:
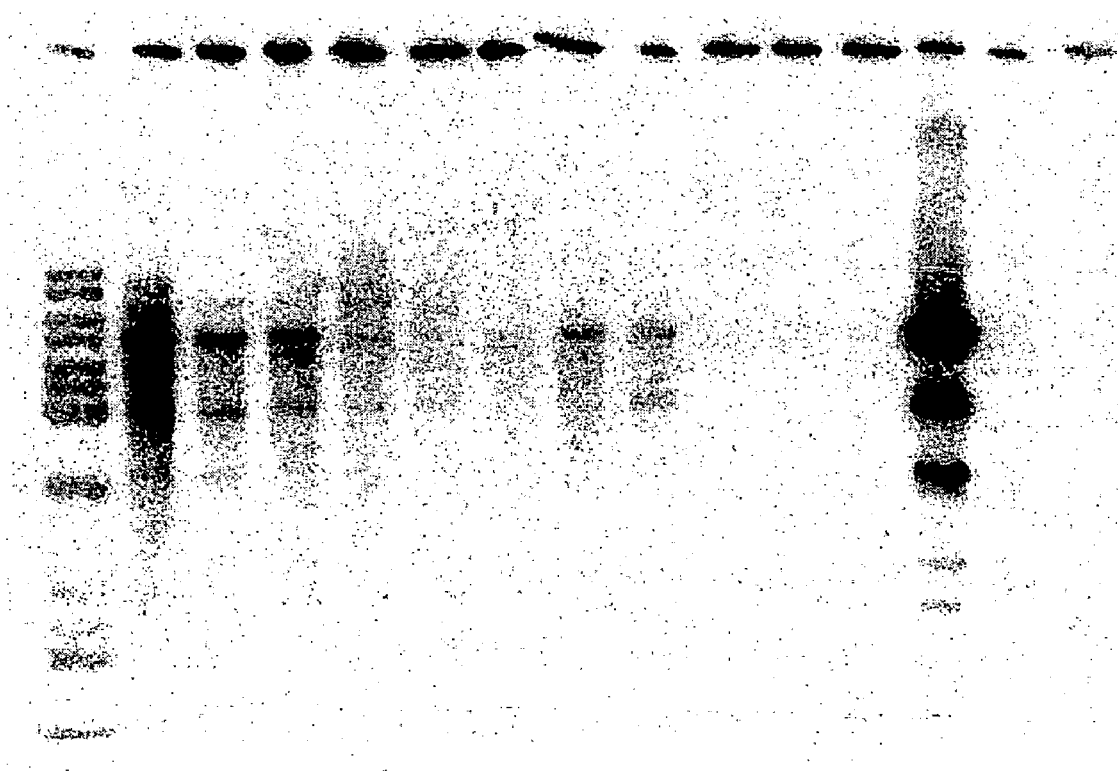
FIG. 14 is a southern blot showing copy number-dependence of STAR function. Southern blot of luciferase expression units in pSDH-Tet-STAR10, integrated into U-2 OS genomic DNA. Radioactive luciferase DNA probe was used to detect the amount of transgene DNA in the genome of each clone, which was then quantified with a phosphorimager.

Materials and Methods:

U-2 OS cells were co-transfected with pSDH-Tet-STAR10 and cultivated under puromycin selection as described (supra). Eight individual clones were isolated and cultivated further. Then cells were harvested, and one portion was assayed for luciferase activity as described (supra). The remaining cells were lysed and the genomic DNA purified using the DNeasy® Tissue Kit (QIAGEN® 69504) as described by the manufacturer. DNA samples were quantitated by UV spectrophotometry. Three micrograms of each genomic DNA sample were digested with PvuII and XhoI overnight as described by the manufacturer (New England Biolabs), and resolved by agarose gel electrophoresis. DNA fragments were transferred to a nylon membrane as described (Sambrook et al., 1989), and hybridized with a radioactively labeled probe to the luciferase gene (isolated from BamHI/SacII-digested pSDH-Tet). The blot was washed as described (Sambrook et al., 1989) and exposed to a phosphorimager screen (Personal F/X, BioRad). The resulting autoradiogram (FIG. 14) was analyzed by densitometry to determine the relative strength of the luciferase DNA bands, which represents the transgene copy number.

Results

Figure 15:
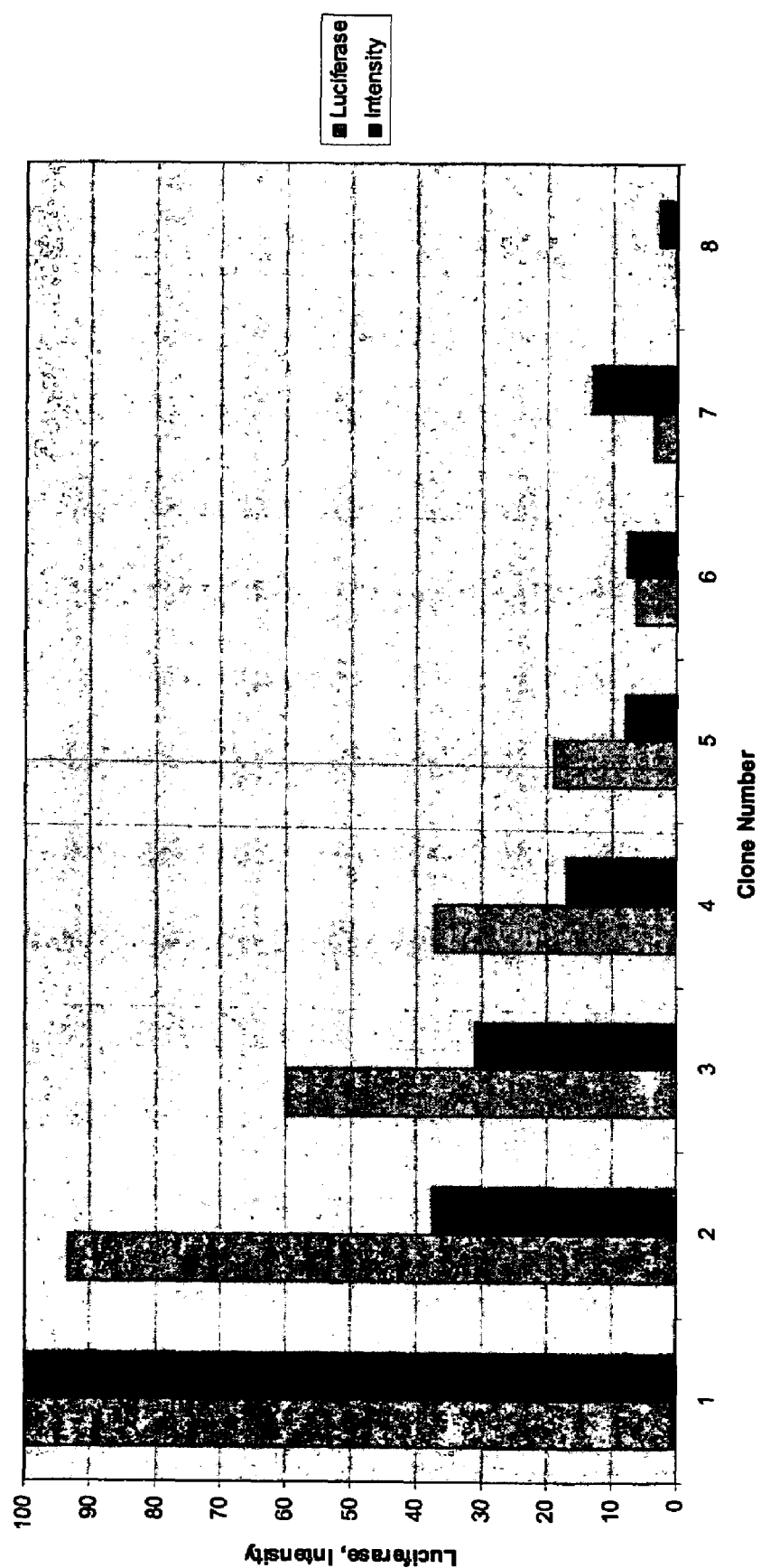
FIG. 15 is a graph illustrating copy number-dependence of STAR function. The copy number of pSDH-Tet-STAR10 expression units in each clone was determined by phosphorimagery, and compared with the activity of the luciferase reporter enzyme expressed by each clone.

The enzyme activities and copy numbers (DNA band intensities) of luciferase in the clones from the pSDH-Tet-STAR10 clone population is shown in FIG. 15. The transgene copy number is highly correlated with the level of luciferase expression in these pSDH-Tet-STAR10 clones (r=0.86). This suggests that STAR10 (SEQ ID NO:10) confers copy number-dependence on the transgene expression units, making transgene expression independent of other transgene copies in tandem arrays, and independent of gene-silencing influences at the site of integration.

Example 11

STAR Elements Function as Enhancer Blockers but not Enhancers

Gene promoters are subject to both positive and negative influences on their ability to initiate transcription. An important class of elements that exert positive influences are enhancers. Enhancers are characteristically able to affect promoters even when they are located far away (many kilobase pairs) from the promoter. Negative influences that act by heterochromatin formation (e.g., Polycomb group proteins) have been described above, and these are the target of STAR activity. The biochemical basis for enhancer function and for heterochromatin formation is fundamentally similar, since they both involve binding of proteins to DNA. Therefore, it is important to determine whether STAR elements are able to block positive influences as well as negative influences, in other words, to shield transgenes from genomic enhancers in the vicinity of the site of integration. The ability to shield transgenes from enhancer activity ensures stable and predictable performance of transgenes in biotechnological applications. This example examines the performance of STAR elements in an enhancer-blocking assay.

Another feature of STAR activity that is important to their function is the increased yield they confer on transgenes (Example 4). STARs are isolated on the basis of their ability to maintain high levels of zeocin expression when heterochromatin-forming proteins are bound adjacent to the candidate STAR elements. High expression is predicted to occur because STARs are anticipated to block the spread of heterochromatin into the zeocin expression unit. However, a second scenario is that the DNA fragments in zeocin-resistant clones contain enhancers. Enhancers have been demonstrated to have the ability to overcome the repressive effects of Polycomb-group proteins such as those used in the method of the STAR screen (Zink & Paro, 1995). Enhancers isolated by this phenomenon would be considered false positives, since enhancers do not have the properties claimed here for STARs. In order to demonstrate that STAR elements are not enhancers, they have been tested in an enhancer assay.

Figure 16:
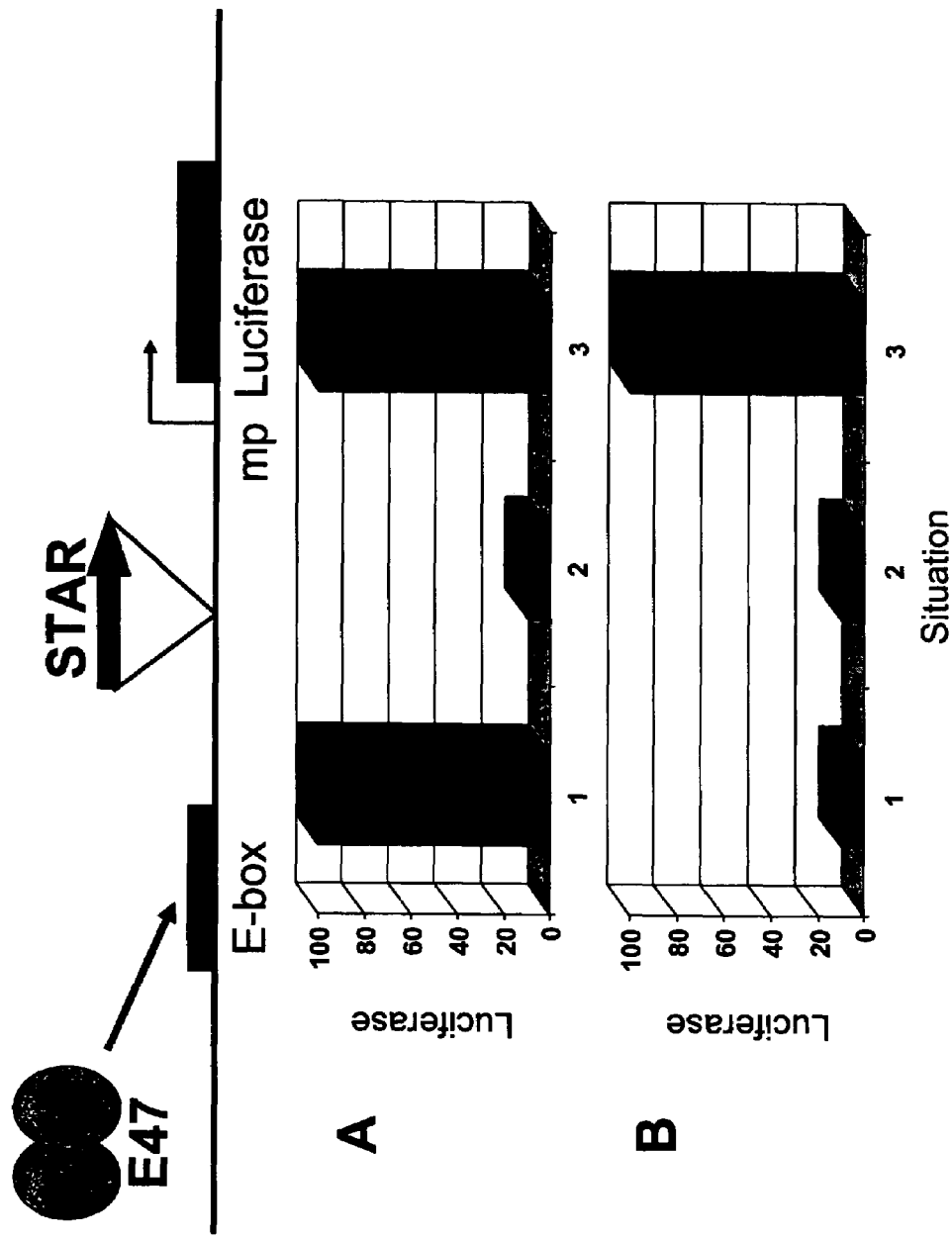
FIG. 16 contains graphs illustrating enhancer-blocking and enhancer assays. The luciferase expression vectors used for testing STARs for enhancer-blocking and enhancer activity are shown schematically. The E-box binding site for the E47 enhancer protein is upstream of a cloning site for STAR elements. Downstream of the STAR cloning site is the luciferase gene under control of a human alkaline phosphatase minimal promoter (mp). The histograms indicate the expected outcomes for the three possible experimental situations (see text). Panel A: Enhancer-blocking assay. Panel B: Enhancer assay.

The enhancer-blocking assay and the enhancer assay are methodologically and conceptually similar. The assays are shown schematically in FIG. 16. The ability of STAR elements to block enhancers is performed using the E47/E-box enhancer system. The E47 protein is able to activate transcription by promoters when it is bound to an E-box DNA sequence located in the vicinity of those promoters (Quong et al., 2002). E47 is normally involved in regulation of B and T lymphocyte differentiation (Quong et al., 2002), but it is able to function in diverse cell types when expressed ectopically (Petersson et al., 2002). The E-box is a palindromic DNA sequence, CANNTG (SEQ ID NO:120) (Knofler et al., 2002). In the enhancer-blocking assay, an E-box is placed upstream of a luciferase reporter gene (including a minimal promoter) in an expression vector. A cloning site for STAR elements is placed between the E-box and the promoter. The E47 protein is encoded on a second plasmid. The assay is performed by transfecting both the E47 plasmid and the luciferase expression vector into cells; the E47 protein is expressed and binds to the E-box, and the E47/E-box complex is able to act as an enhancer. When the luciferase expression vector does not contain a STAR element, the E47/E-box complex enhances luciferase expression (FIG. 16A, situation 1). When STAR elements are inserted between the E-box and the promoter, their ability to block the enhancer is demonstrated by reduced expression of luciferase activity (FIG. 16A, situation 2); if STARs cannot block enhancers, luciferase expression is activated (FIG. 16A, situation 3).

The ability of STAR elements to act as enhancers utilizes the same luciferase expression vector. In the absence of E47, the E-box itself does not affect transcription. Instead, enhancer behavior by STAR elements will result in activation of luciferase transcription. The assay is performed by transfecting the luciferase expression vector without the E47 plasmid. When the expression vector does not contain STAR elements, luciferase expression is low (FIG. 16B, situation 1). If STAR elements do not have enhancer properties, luciferase expression is low when a STAR element is present in the vector (FIG. 16B, situation 2). If STAR elements do have enhancer properties, luciferase expression will be activated in the STAR-containing vectors (FIG. 16B, situation 3).

Materials and Methods:

The luciferase expression vector was constructed by inserting the E-box and a human alkaline phosphatase minimal promoter from plasmid mu-E5+E2x6-cat(x) (Ruezinsky et al., 1991) upstream of the luciferase gene in plasmid pGL3-basic (Promega E1751), to create pGL3-E-box-luciferase (gift of W. Romanow). The E47 expression plasmid contains the E47 open reading frame under control of a beta-actin promoter in the pHBAPr-1-neo plasmid; E47 in constitutively expressed from this plasmid (gift of W. Romanow).

STAR elements 1, 2, 3, 6, 10, 11, 18, and 27 (SEQ ID NOS:1, 2, 3, 6, 10, 11, 18 and 27, respectively) have been cloned into the luciferase expression vector. Clones containing the *Drosophila* scs element and the chicken beta-globin HS4-6x core ("HS4") element have been included as positive controls (they are known to block enhancers, and to have no intrinsic enhancer properties (Chung et al., 1993, Kellum & Schedl, 1992)), and the empty luciferase expression vector has been included as a negative control. All assays were performed using the U-2 OS cell line. In the enhancer-blocking assay, the E47 plasmid was co-transfected with the luciferase expression vectors (empty vector, or containing STAR or positive-control elements). In the enhancer assay, the E47 plasmid was co-transfected with STARless luciferase expression vector as a positive control for enhancer activity; all other samples received a mock plasmid during co-transfection. The transiently transfected cells were assayed for luciferase activity 48 hours after plasmid transfection (supra). The luciferase activity expressed from a plasmid containing no E-box or STAR/control elements was subtracted, and the luciferase activities were normalized to protein content as described (supra).

Results

Figure 17:
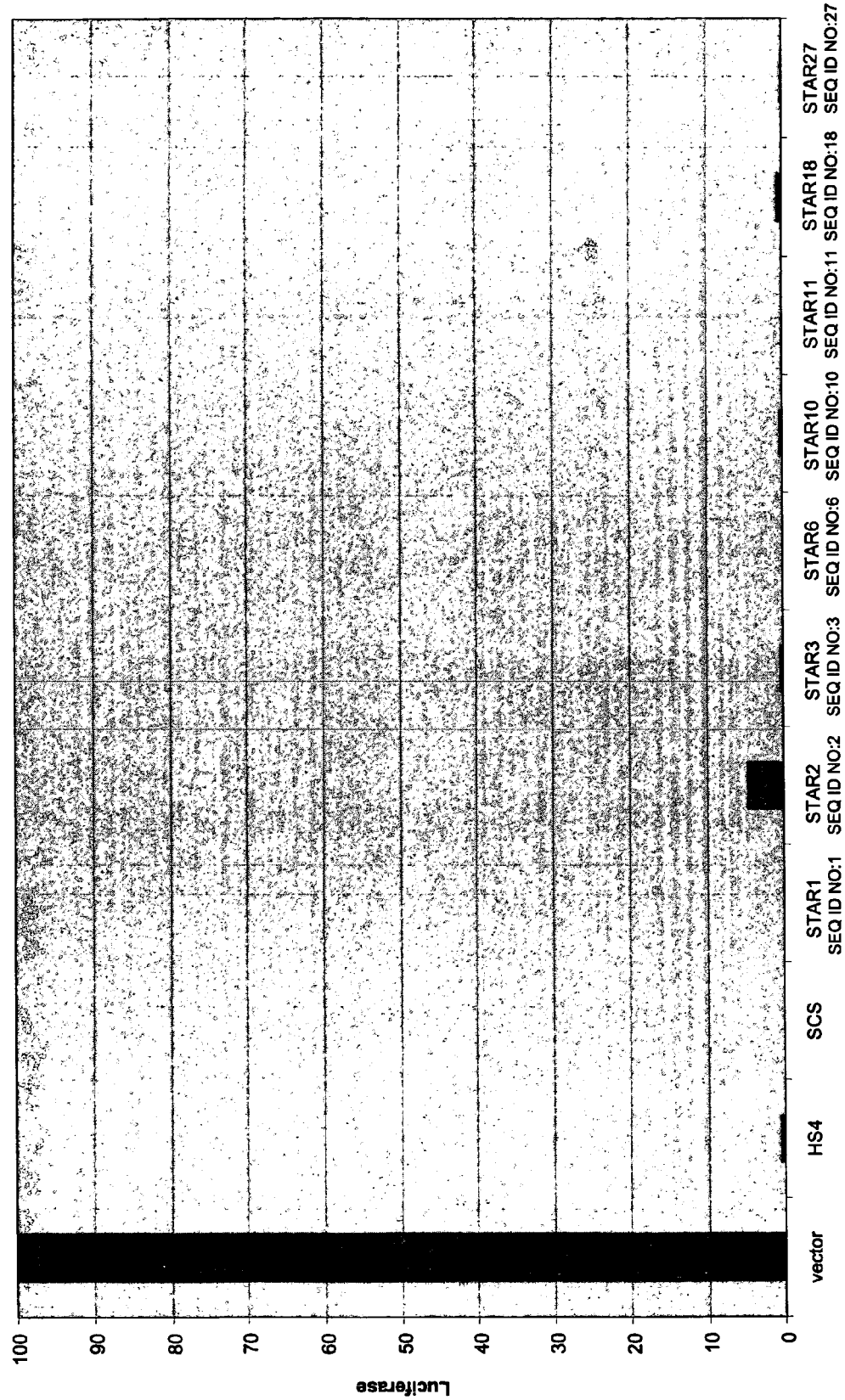
FIG. 17 is a graph depicting the enhancer-blocking assay. Luciferase expression from a minimal promoter is activated by the E47/E-box enhancer in the empty vector (vector). Insertion of enhancer-blockers (scs, HS4) or STAR elements (STAR elements 1, 2, 3, 6, 10, 11, 18, and 27; SEQ ID NOS:1, 2, 3, 6, 10, 11, 18, and 27, respectively) block luciferase activation by the E47/E-box enhancer.

FIG. 17 shows the results of the enhancer-blocking assay. In the absence of STAR elements (or the known enhancer-blocking elements scs and HS4), the E47/E-box enhancer complex activates expression of luciferase ("vector"); this enhanced level of expression has been normalized to 100. Enhancer activity is blocked by all STAR elements tested. Enhancer activity is also blocked by the HS4 and scs elements, as expected (Bell et al., 2001, Gerasimova & Corces, 2001). These results demonstrate that in addition to their ability to block the spreading of transcriptional silencing (negative influences), STAR elements are able to block the action of enhancers (positive influences).

Figure 18:
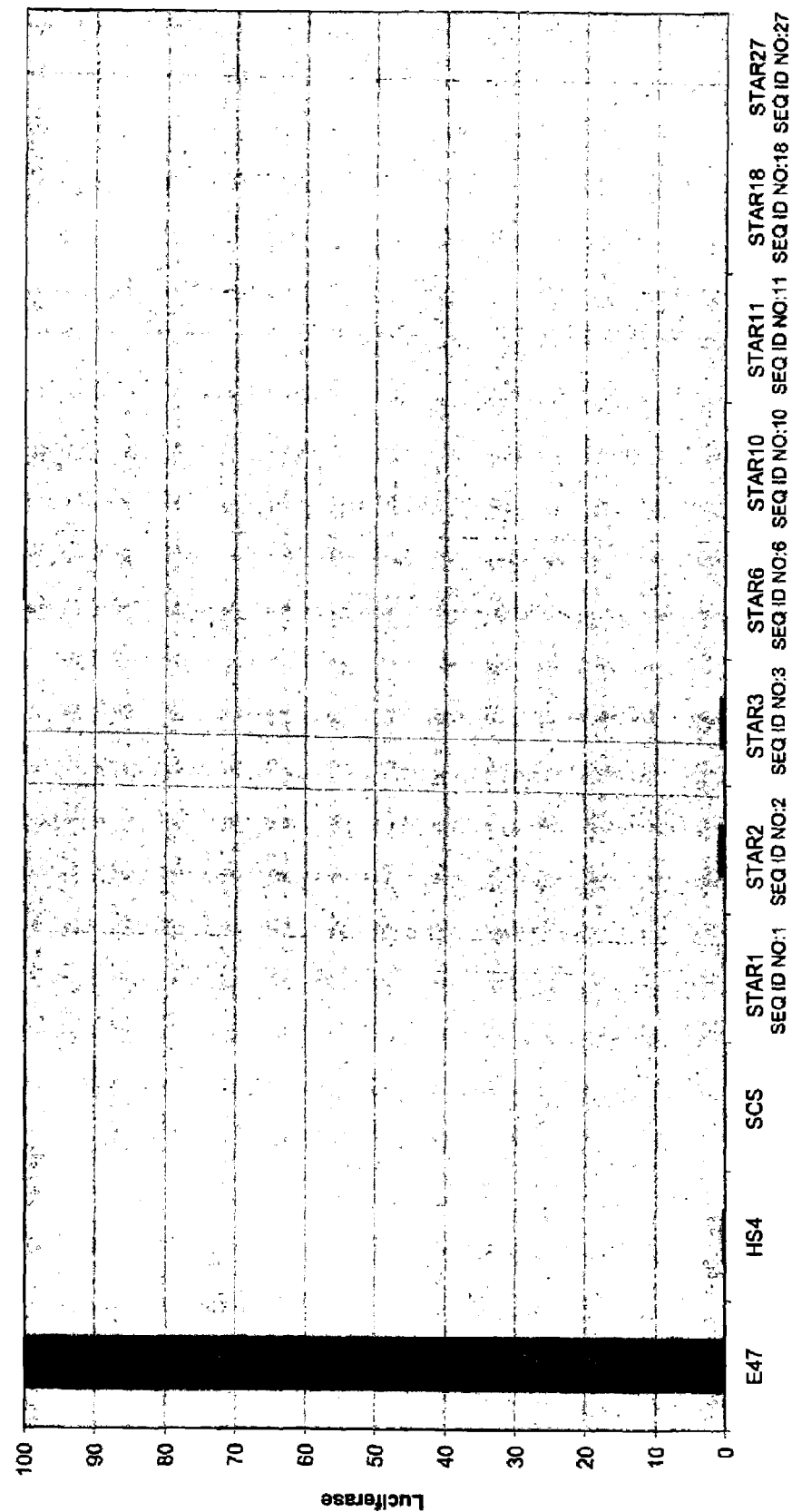
FIG. 18 is a graph illustrating an enhancer assay. Luciferase expression from a minimal promoter is activated by the E47/E-box enhancer in the empty vector (E47). Insertion of the scs and HS4 elements or various STAR elements (STARs 1, 2, 3, 6, 10, 11, 18, and 27; SEQ ID NOS:1, 2, 3, 6, 10, 11, 18, and 27, respectively) do not activate transcription of the reporter gene.

FIG. 18 shows the results of the enhancer assay. The level of luciferase expression due to enhancement by the E47/E-box complex is set at 100 ("E47"). By comparison, none of the STAR elements bring about significant activation of luciferase expression. As expected, the scs and HS4 elements also do not bring about activation of the reporter gene. Therefore, it is concluded that at least the tested STAR elements do not possess enhancer properties.

Example 12

STAR Elements are Conserved Between Mouse and Human

BLAT analysis of the STAR DNA sequence against the human genome database (WorldWideWeb.genome.ucsc.edu/cgi-bin/hgGateway) reveals that some of these sequences have high sequence conservation with other regions of the human genome. These duplicated regions are candidate STAR elements; if they do show STAR activity, they would be considered paralogs of the cloned STARs (two genes or genetic elements are said to be paralogous if they are derived from a duplication event (Li, 1997)).

BLAST analysis of the human STARs against the mouse genome (WorldWideWeb.ensembl.org/Mus_musculus/blastview) also reveals regions of high sequence conservation between mouse and human. This sequence conservation has been shown for fragments of 15 out of the 65 human STAR elements. The conservation ranges from 64% to 89%, over lengths of 141 base pairs to 909 base pairs (Table 8). These degrees of sequence conservation are remarkable and suggest that these DNA sequences may confer STAR activity within the mouse genome as well. Some of the sequences from the mouse and human genomes in Table 8 could be strictly defined as orthologs (two genes or genetic elements are said to be orthologous if they are derived from a speciation event (Li, 1997)). For example, STAR6 (SEQ ID NO:6) is between the SLC8A1 and HAAO genes in both the human and mouse genomes. In other cases, a cloned human STAR has a paralog within the human genome, and its ortholog has been identified in the mouse genome. For example, STAR3a (SEQ ID NO:3) is a fragment of the 15q11.2 region of human chromosome 15. This region is 96.9% identical (paralogous) with a DNA fragment at 5q33.3 on human chromosome 5, which is near the IL12B interleukin gene. These human DNAs share approximately 80% identity with a fragment of the 11B2 region on mouse chromosome 11. The 11B2 fragment is also near the (mouse) IL12B interleukin gene. Therefore, STAR3a (SEQ ID NO:3) and the mouse 11B2 fragment can be strictly defined as paralogs.

In order to test the hypothesis that STAR activity is shared between regions of high sequence conservation in the mouse and human genome, one of the human STARs with a conserved sequence in mouse, STAR18 (SEQ ID NO:18), has been analyzed in greater detail.

Figure 19:
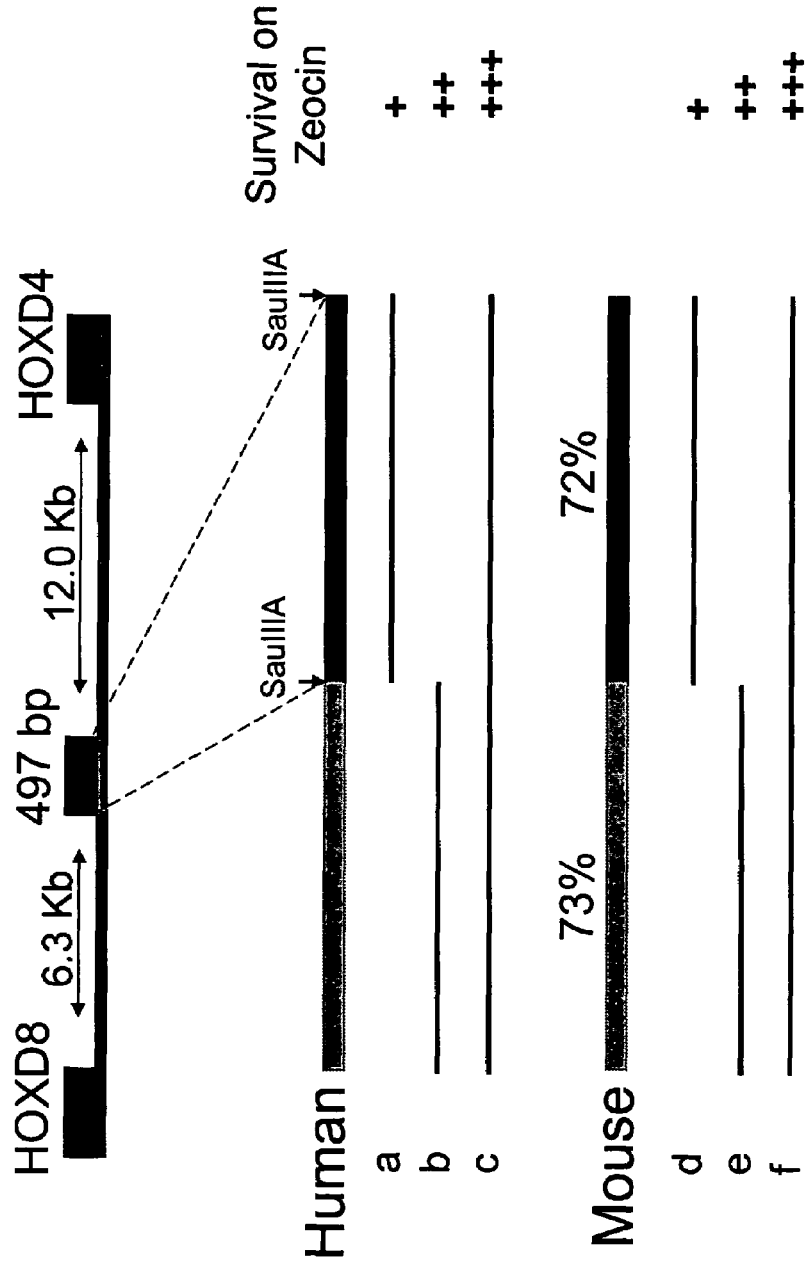
FIG. 19 contains graphs illustrating STAR18 (SEQ ID NO:18) sequence conservation between mouse and human. The region of the human genome containing 497 base pair STAR18 (SEQ ID NO:18) is shown (black boxes); the element occurs between the HOXD8 and HOXD4 homeobox genes on human chromosome 2. It is aligned with a region in mouse chromosome 2 that shares 72% sequence identity. The region of human chromosome 2 immediately to the left of STAR18 is also highly conserved with mouse chromosome 2 (73% identity; gray boxes); beyond these region, the identity drops below 60%. The ability of these regions from human and mouse, either separately or in combination, to confer growth on zeocin is indicated: −, no growth; +, moderate growth; ++, vigorous growth; +++, rapid growth.

The sequence conservation in the mouse genome detected with the original STAR18 clone extends leftward on human chromosome 2 for about 500 base pairs (FIG. 19; left and right relate to the standard description of the arms of chromosome 2). In this example, we examine whether the region of sequence conservation defines a "naturally occurring" STAR element in human that is more extensive in length than the original clone. We also examine whether the STAR function of this STAR element is conserved between mouse and human.

Materials and Methods

The region of mouse/human sequence conservation around STAR 18 (SEQ ID NO:18) was recovered from human BAC clone RP11-387A1 by PCR amplification, in three fragments: the entire region (primers E93 and E94, SEQ ID NOS:180 and 181, respectively), the leftward half (primers E93 and E92, SEQ ID NOS:180 and 179, respectively), and the rightward half (primers E57 and E94, SEQ ID NOS:175 and 181, respectively). The corresponding fragments from the homologous mouse region were recovered from BAC clone RP23-400H17 in the same fashion (primers E95 (SEQ ID NO:182) and E98 (SEQ ID NO:185), E95 (SEQ ID NO:182) and E96 (SEQ ID NO:183), and E97 (SEQ ID NO:184) and E98 (SEQ ID NO:185), respectively). All fragments were cloned into the pSelect vector and transfected into a U-2 OS/Tet-Off/LexA-HP1 cell line (supra). Following transfection, hygromycin selection was carried out to select for transfected cells. The LexA-HP1 protein was induced by lowering the doxycycline concentration, and the ability of the transfected cells to withstand the antibiotic zeocin (a measure of STAR activity) was assessed by monitoring cell growth.

Results

Figure 21:
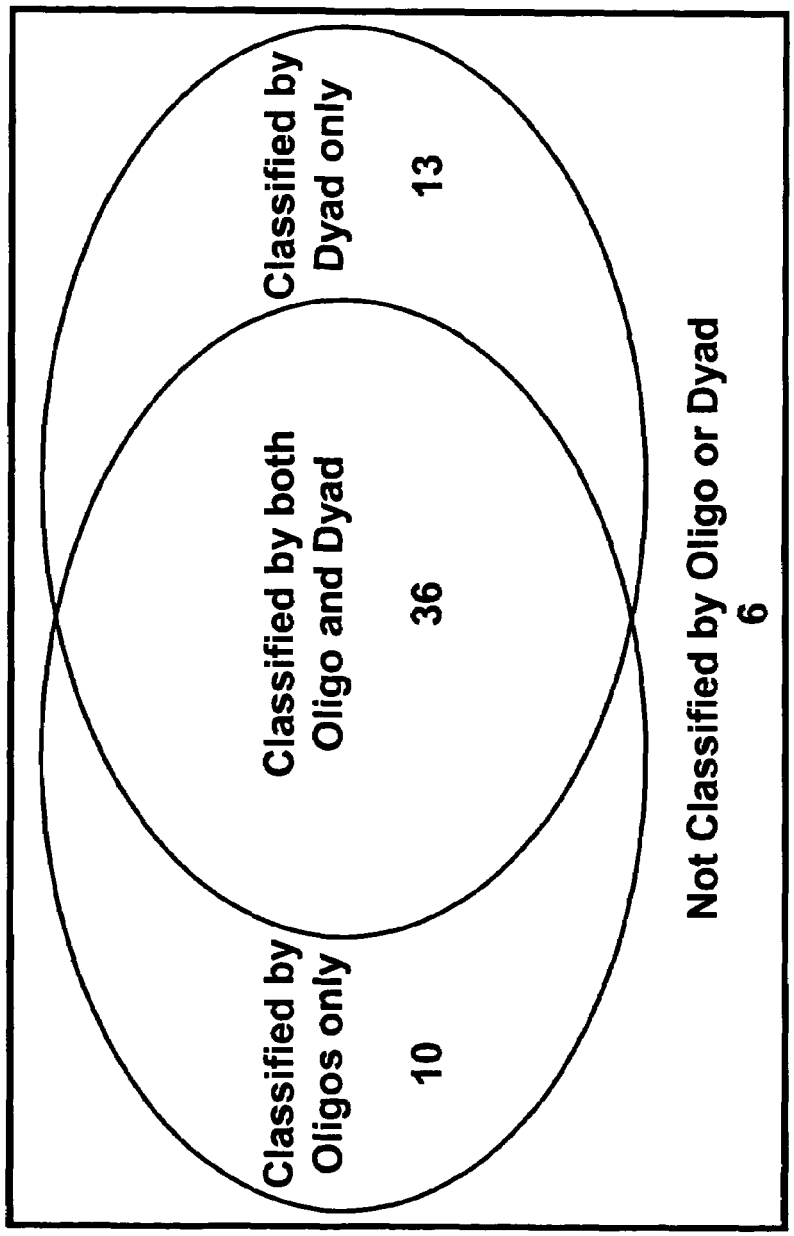
FIG. 21 is a diagram illustrating the results of discriminant analysis on classification of the training set of 65 STAR elements. STAR elements that are correctly classified as STARs by Stepwise Linear Discriminant Analysis (LDA) are shown in a Venn diagram. The variables for LDA were selected from frequency analysis results for hexameric oligonucleotides ("oligos") and for dyads. The diagram indicates the concordance of the two sets of variables in correctly classifying STARs.

The original STAR18 clone was isolated from Sau3AI digested human DNA ligated into the pSelect vector on the basis of its ability to prevent silencing of a zeocin resistance gene. Alignment of the human STAR18 clone (497 base pairs) with the mouse genome revealed high sequence similarity (72%) between the orthologous human and mouse STAR18 (SEQ ID NO:18) regions. It also uncovered high similarity (73%) in the region extending for 488 base pairs immediately leftwards of the Sau3AI site that defines the left end of the cloned region (FIG. 21). Outside these regions the sequence similarity between human and mouse DNA drops below 60%.

As indicated in FIG. 19, both the human STAR18 (SEQ ID NO:18) and the mouse STAR18 elements confer survival on zeocin to host cells expressing the lexA-HP1 repressor protein. The original 497 base pair STAR18 clone and its mouse ortholog both confer the ability to grow (FIG. 19, *a* and *d*). The adjacent 488 base pair regions of high similarity from both genomes also confer the ability to grow, and in fact their growth phenotype is more vigorous than that of the original STAR18 clone (FIG. 19, *b* and *e*). When the entire region of sequence similarity was tested, these DNAs from both mouse and human confer growth, and the growth phenotype is more vigorous than the two sub-fragments (FIG. 19, *c* and *f*). These results demonstrate that the STAR activity of human STAR18 (SEQ ID NO:18) is conserved in its ortholog from mouse. The high sequence conservation between these orthologous regions is particularly noteworthy because they are not protein-coding sequences, leading to the conclusion that they have some regulatory function that has prevented their evolutionary divergence through mutation.

This analysis demonstrates that cloned STAR elements identified by the original screening program may in some cases represent partial STAR elements, and that analysis of the genomic DNA in which they are embedded can identify sequences with stronger STAR activity.

Example 13

STAR Elements Contain Characteristic DNA Sequence Motifs

STAR elements are isolated on the basis of their anti-repression phenotype with respect to transgene expression. This anti-repression phenotype reflects underlying biochemical processes that regulate chromatin formation which are associated with the STAR elements. These processes are typically sequence-specific and result from protein binding or DNA structure. This suggests that STAR elements will share DNA sequence similarity. Identification of sequence similarity among STAR elements will provide sequence motifs that are characteristic of the elements that have already been identified by functional screens and tests. The sequence motifs will also be useful to recognize and claim new STAR elements whose functions conform to the claims of this patent. The functions include improved yield and stability of transgenes expressed in eukaryotic host cells.

Other benefits of identifying sequence motifs that characterize STAR elements include: (1) provision of search motifs for prediction and identification of new STAR elements in genome databases, (2) provision of a rationale for modification of the elements, and (3) provision of information for functional analysis of STAR activity. Using bio-informatics, sequence similarities among STAR elements have been identified; the results are presented in this example.

Bio-informatic and Statistical Background. Regulatory DNA elements typically function via interaction with sequence-specific DNA-binding proteins. Bio-informatic analysis of DNA elements such as STAR elements whose regulatory properties have been identified, but whose interacting proteins are unknown, requires a statistical approach for identification of sequence motifs. This can be achieved by a method that detects short DNA sequence patterns that are over-represented in a set of regulatory DNA elements (e.g., the STAR elements) compared to a reference sequence (e.g., the complete human genome). The method determines the number of observed and expected occurrences of the patterns in each regulatory element. The number of expected occurrences is calculated from the number of observed occurrences of each pattern in the reference sequence.

The DNA sequence patterns can be oligonucleotides of a given length, e.g., six base pairs. In the simplest analysis, for a 6 base pair oligonucleotide (hexamer) composed of the four nucleotides (A, C, G, and T) there are $4^6$=4096 distinct oligonucleotides (all combinations from AAAAAA to TTTTTT, SEQ ID NOS:121 and 122, respectively). If the regulatory and reference sequences were completely random and had equal proportions of the A, C, G, and T nucleotides, then the expected frequency of each hexamer would be 1/4096 (~0.00024). However, the actual frequency of each hexamer in the reference sequence is typically different than this due to biases in the content of G:C base pairs, etc. Therefore, the frequency of each oligonucleotide in the reference sequence is determined empirically by counting, to create a "frequency table" for the patterns.

The pattern frequency table of the reference sequence is then used to calculate the expected frequency of occurrence of each pattern in the regulatory element set. The expected frequencies are compared with the observed frequencies of occurrence of the patterns. Patterns that are "over-represented" in the set are identified; for example, if the hexamer ACGTGA (SEQ ID NO:123) is expected to occur five times in 20 kilobase pairs of sequence, but is observed to occur 15 times, then it is three-fold over-represented. Ten of the 15 occurrences of that hexameric sequence pattern would not be expected in the regulatory elements if the elements had the same hexamer composition as the entire genome. Once the over-represented patterns are identified, a statistical test is applied to determine whether their over-representation is significant, or may be due to chance. For this test, a significance index, "sig," is calculated for each pattern. The significance index is derived from the probability of occurrence of each pattern, which is estimated by a binomial distribution. The probability takes into account the number of possible patterns (4096 for hexamers). The highest sig values correspond to the most overrepresented oligonucleotides (van Helden et al., 1998). In practical terms, oligonucleotides with sig$\geq$0 are considered as over-represented. A pattern with sig$\geq$0 is likely to be over-represented due to chance once (=$10^0$) in the set of regulatory element sequences. However, at sig$\geq$1 a pattern is expected to be over-represented once in ten (=$10^1$) sequence sets, sig$\geq$2 once in 100(=$10^2$) sequence sets, etc.

The patterns that are significantly over-represented in the regulatory element set are used to develop a model for classification and prediction of regulatory element sequences. This employs Discriminant Analysis, a so-called "supervised" method of statistical classification known to one of ordinary skill in the art (Huberty, 1994). In Discriminant Analysis, sets of known or classified items (e.g., STAR elements) are used to "train" a model to recognize those items on the basis of specific variables (e.g., sequence patterns such as hexamers). The trained model is then used to predict whether other items should be classified as belonging to the set of known items (e.g., is a DNA sequence STAR element). In this example, the known items in the training set are STAR elements (positive training set). They are contrasted with sequences that are randomly selected from the genome (negative training set) which have the same length as the STAR elements. Discriminant Analysis establishes criteria for discriminating positives from negatives based on a set of variables that distinguish the positives; in this example, the variables are the significantly over-represented patterns (e.g., hexamers).

When the number of over-represented patterns is high compared to the size of the training set, the model could become biased due to over-training. Over-training is circumvented by applying a forward stepwise selection of variables (Huberty, 1994). The goal of Stepwise Discriminant Analysis is to select the minimum number of variables that provides maximum discrimination between the positives and negatives. The model is trained by evaluating variables one-by-one for their ability to properly classify the items in the positive and negative training sets. This is done until addition of new variables to the model does not significantly increase the model's predictive power (i.e., until the classification error rate is minimized). This optimized model is then used for testing, in order to predict whether "new" items are positives or negatives (Huberty, 1994).

It is inherent in classification statistics that for complex items such as DNA sequences, some elements of the positive training set will be classified as negatives (false negatives), and some members of the negative training set will be classified as positives (false positives). When a trained model is applied to testing new items, the same types of misclassifications are expected to occur.

In the bio-informatic method described here, the first step, pattern frequency analysis, reduces a large set of sequence patterns (e.g., all 4096 hexamers) to a smaller set of significantly over-represented patterns (e.g., 100 hexamers); in the second step, Stepwise Discriminant Analysis reduces the set of over-represented patterns to the subset of those patterns that have maximal discriminative power (e.g., 5-10 hexamers). Therefore, this approach provides simple and robust criteria for identifying regulatory DNA elements such as STAR elements.

DNA-binding proteins can be distinguished on the basis of the type of binding site they occupy. Some recognize contiguous sequences; for this type of protein, patterns that are oligonucleotides of length 6 base pairs (hexamers) are fruitful for bio-informatic analysis (van Helden et al., 1998). Other proteins bind to sequence dyads: contact is made between pairs of highly conserved trinucleotides separated by a non-conserved region of fixed width (van Helden et al., 2000). In order to identify sequences in STAR elements that may be bound by dyad-binding proteins, frequency analysis was also conducted for this type of pattern, where the spacing between the two trinucleotides was varied from 0 to 20 (i.e., XXXN{0-20}XXX where X's are specific nucleotides composing the trinucleotides, and N's are random nucleotides from 0 to 20 base pairs in length). The results of dyad frequency analysis are also used for Linear Discriminant Analysis as described above.

Materials and Methods

Using the genetic screen described herein and in EP 01202581.3, sixty-six (66) STAR elements were initially isolated from human genomic DNA and characterized in detail (Table 6). The screen was performed on gene libraries constructed by Sau3AI digestion of human genomic DNA, either purified from placenta (Clontech 6550-1) or carried in bacterial/P1 (BAC/PAC) artificial chromosomes. The BAC/

PAC clones contain genomic DNA from regions of chromosome 1 (clones RP1154H19 and RP3328E19), from the HOX cluster of homeotic genes (clones RP1167F23, RP1170003, and RP11387A1), or from human chromosome 22 (Research Genetics 96010-22). The DNAs were size-fractionated, and the 0.5-2 kb size fraction was ligated into BamHI-digested pSelect vector, by standard techniques (Sambrook et al., 1989). pSelect plasmids containing human genomic DNA that conferred resistance to zeocin at low doxycycline concentrations were isolated and propagated in *Escherichia coli*. The screens that yielded the STAR elements of Table 6 have assayed approximately 1-2% of the human genome.

The human genomic DNA inserts in these 66 plasmids were sequenced by the dideoxy method (Sanger et al., 1977) using a Beckman CEQ2000 automated DNA sequencer, using the manufacturer's instructions. Briefly, DNA was purified from *E coli* using QIAprep® Spin Miniprep and Plasmid Midi Kits (QIAGEN® 27106 and 12145, respectively). Cycle sequencing was carried out using custom oligonucleotides corresponding to the pSelect vector (primers D89 and D95, Table 1), in the presence of dye terminators (CEQ™ Dye Terminator Cycle Sequencing Kit, Beckman 608000). Assembled STAR DNA sequences were located in the human genome (database builds August and December 2001) using BLAT (Basic Local Alignment Tool (Kent, 2002); WorldWideWeb.genome.ucsc.edu/cgi-bin/hg-Gateway; Table 6). In aggregate, the combined STAR sequences comprise 85.6 kilobase pairs, with an average length of 1.3 kilobase pairs.

Figure 20:
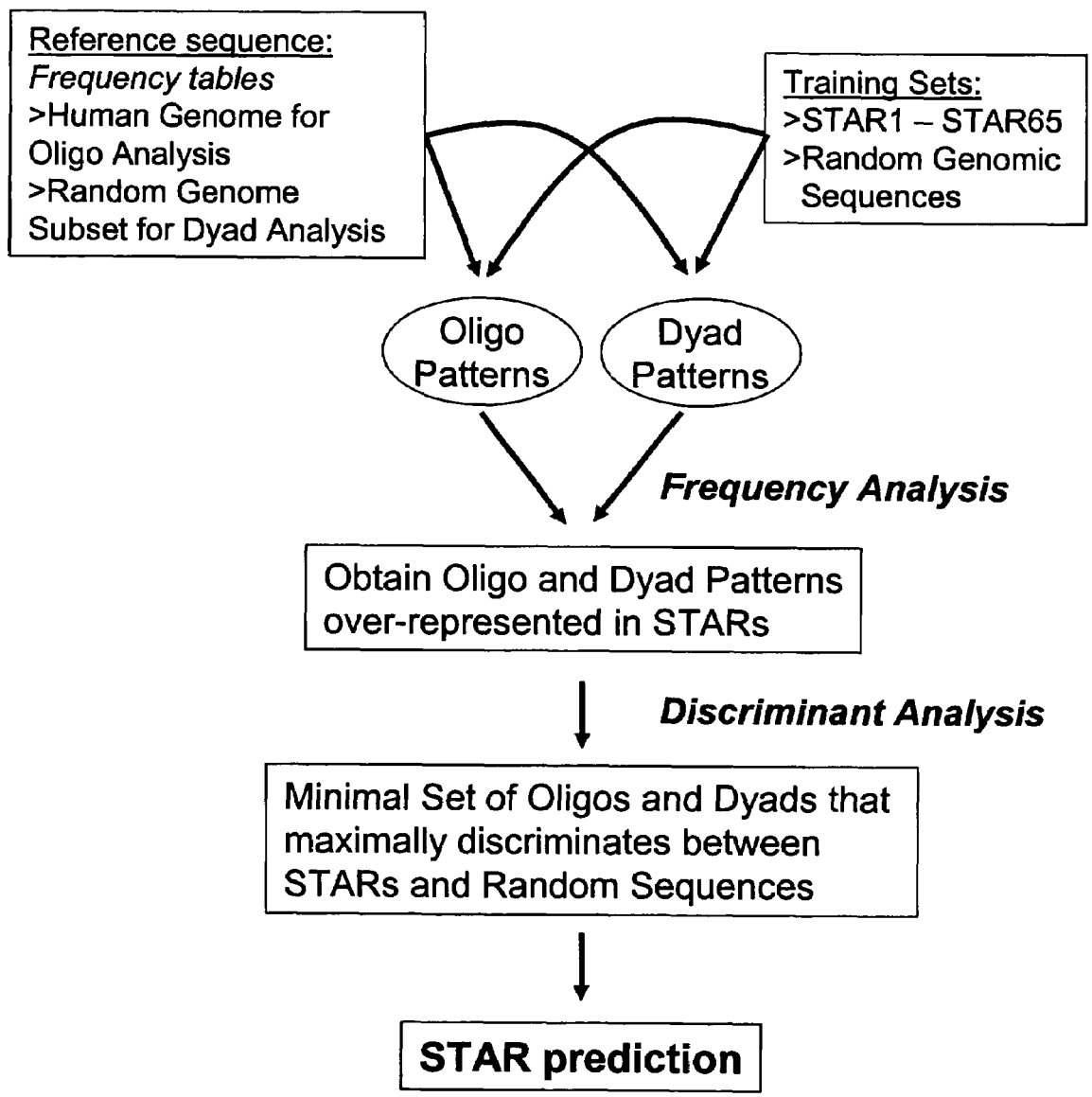
FIG. 20 is a schematic diagram of bio-informatical analysis workflow. For details, see text.

Sequence motifs that distinguish STAR elements within human genomic DNA were identified by bio-informatic analysis using a two-step procedure, as follows (see FIG. 20 for a schematic diagram). The analysis has two input datasets: (1) the DNA sequences of the STAR elements (STAR1-STAR65 (SEQ ID NOS:1-65) were used; Table 6); and (2) the DNA sequence of the human genome (except for chromosome 1, which was not feasible to include due to its large size; for dyad analysis a random subset of human genomic DNA sequence (~27 Mb) was used).

Pattern Frequency Analysis. The first step in the analysis uses RSA-Tools software (Regulatory Sequence Analysis Tools; WorldWideWeb.ucmb.ulb.ac.be/bioinformatics/rsa-tools/; references (van Helden et al., 1998, van Helden et al., 2000, van Helden et al., 2000)) to determine the following information: (1) the frequencies of all dyads and hexameric oligonucleotides in the human genome; (2) the frequencies of the oligonucleotides and dyads in the 65 STAR elements; and (3) the significance indices of those oligonucleotides and dyads that are over-represented in the STAR elements compared to the genome. A control analysis was done with 65 sequences that were selected at random from the human genome (i.e., from $2689 \times 10^3$ kilobase pairs) that match the length of the STAR elements of Table 6.

Discriminant Analysis. The over-represented oligonucleotides and dyads were used to train models for prediction of STAR elements by Linear Discriminant Analysis (Huberty, 1994). A pre-selection of variables was performed by selecting the 50 patterns with the highest individual discriminatory power from the over-represented oligos or dyads of the frequency analyses. These pre-selected variables were then used for model training in a Stepwise Linear Discriminant Analysis to select the most discriminant combination of variables (Huberty, 1994). Variable selection was based on minimizing the classification error rate (percentage of false negative classifications). In addition, the expected error rate was estimated by applying the same discriminant approach to the control set of random sequences (minimizing the percentage of false positive classifications).

The predictive models from the training phase of Discriminant Analysis were tested in two ways. First, the STAR elements and random sequences that were used to generate the model (the training sets) were classified. Second, sequences in a collection of 19 candidate STAR elements (recently cloned by zeocin selection as described above) were classified. These candidate STAR elements are listed in Table 9 (SEQ ID NOS:67-84).

Results

Pattern frequency analysis was performed with RSA-Tools on 65 STAR elements, using the human genome as the reference sequence. One hundred sixty-six (166) hexameric oligonucleotides were found to be over-represented in the set of STAR elements (sig≧0) compared to the entire genome (Table 4). The most significantly over-represented oligonucleotide, CCCCAC (SEQ ID NO:391), occurs 107 times among the 65 STAR elements, but is expected to occur only 49 times. It has a significance coefficient of 8.76; in other words, the probability that its over-representation is due to random chance is $1/10^{8.76}$, i.e., less than one in 500 million.

Ninety-five of the oligonucleotides have a significance coefficient greater than one, and are, therefore, highly over-represented in the STAR elements. Among the over-represented oligonucleotides, their observed and expected occurrences, respectively, range from six and one (for oligo 163, CGCGAA (SEQ ID NO:380), sig=0.02) to 133 and 95 (for oligo 120, CCCAGG (SEQ ID NO:337), sig=0.49). The differences in expected occurrences reflect factors such as the G:C content of the human genome. Therefore, the differences among the oligonucleotides in their number of occurrences is less important than their over-representation; for example, oligo 2 (CAGCGG (SEQ ID NO:386)) is 36/9=4-fold over-represented, which has a probability of being due to random chance of one in fifty million (sig=7.75).

Table 4 also presents the number of STAR elements in which each over-represented oligonucleotide is found. For example, the most significant oligonucleotide, oligo 1 (CCCCAC (SEQ ID NO:391)), occurs 107 times, but is found in only 51 STARs, i.e., on average it occurs as two copies per STAR. The least abundant oligonucleotide, number 166 (AATCGG (SEQ ID NO:383)), occurs on average as a single copy per STAR (thirteen occurrences on eleven STARs); single-copy oligonucleotides occur frequently, especially for the lower-abundance oligos. At the other extreme, oligo 4 (CAGCCC (SEQ ID NO:568)) occurs on average three times in those STARs in which it is found (37 STARs). The most widespread oligonucleotide is number 120 (CCCAGG (SEQ ID NO:337)), which occurs on 58 STARs (on average twice per STAR), and the least widespread oligonucleotide is number 114 (CGTCGC (SEQ ID NO:331)), which occurs on only 6 STARs (and on average only once per STAR).

Results of dyad frequency analysis are given in Table 5. Seven hundred thirty (730) dyads were found to be over-represented in the set of STAR elements (sig≧0) compared to the reference sequence. The most significantly over-represented dyad, CCCN{2}CGG (SEQ ID NO:384), occurs 36 times among the 65 STAR elements, but is expected to occur only seven times. It has a significance coefficient of 9.31; in other words, the probability that its over-representation is due to chance is $1/10^{9.31}$, i.e., less than one in two billion.

Three hundred ninety-seven of the dyads have a significance coefficient greater than one, and are, therefore, highly over-represented in the STAR elements. Among the over-represented dyads, their observed and expected occurrences, respectively, range from nine and one (for five dyads (numbers 380 (SEQ ID NO:763), 435 (SEQ ID NO:818), 493 (SEQ ID NO:876), 640 (SEQ ID NO:1023), and 665 (SEQ ID NO:1048))) to 118 and 63 (for number 30 (AGGN{2}GGG) (SEQ ID NO:413), sig=4.44).

The oligonucleotides and dyads found to be over-represented in STAR elements by pattern frequency analysis were tested for their discriminative power by Linear Discriminant Analysis. Discriminant models were trained by step-wise selection of the best combination among the 50 most discriminant oligonucleotide (Table 4) or dyad (Table 5) patterns. The models achieved optimal error rates after incorporation of four (dyad) or five variables. The discriminative variables from oligo analysis are numbers 11 (SEQ ID NO:228), 30 (SEQ ID NO:247), 94 (SEQ ID NO:311), 122 (SEQ ID NO:339), and 160 (SEQ ID NO:377) (Table 4); those from dyad analysis are numbers 73 (SEQ ID NO:456), 194 (SEQ ID NO:577), 419 (SEQ ID NO:802), and 497 (SEQ ID NO:880) (Table 5).

The discriminant models were then used to classify the 65 STAR elements in the training set and their associated random sequences. The model using oligonucleotide variables classifies 46 of the 65 STAR elements as STAR elements (true positives); the dyad model classifies 49 of the STAR elements as true positives. In combination, the models classify 59 of the 65 STAR elements as STAR elements (91%; FIG. 21). The false positive rates (random sequences classified as STARs) were seven for the dyad model, eight for the oligonucleotide model, and 13 for the combined predictions of the two models (20%). The STAR elements of Table 6 that were not classified as STARs by LDA are STARs 7 (SEQ ID NO:7), 22 (SEQ ID NO:22), 35 (SEQ ID NO:35), 44 (SEQ ID NO:44), 46 (SEQ ID NO:46), and 65 (SEQ ID NO:65). These elements display stabilizing anti-repressor activity in functional assays, so the fact that they are not classified as STARs by LDA suggests that they represent another class (or classes) of STAR elements.

The models were then used to classify the 19 candidate STAR elements in the testing set listed in Table 9. The dyad model classifies 12 of these candidate STAR elements as STAR elements, and the oligonucleotide model classifies 14 as STARs. The combined number of the candidates that are classified as STAR elements is 15 (79%). This is a lower rate of classification than obtained with the training set of 65 STARs; this is expected for two reasons. First, the discriminant models were trained with the 65 STARs of Table 6, and discriminative variables based on this training set may be less well represented in the testing set. Second, the candidate STAR sequences in the testing set have not yet been fully characterized in terms of in vivo function, and may include elements with only weak anti-repression properties.

This analysis demonstrates the power of a statistical approach to bio-informatic classification of STAR elements. The STAR sequences contain a number of dyad and hexameric oligonucleotide patterns that are significantly over-represented in comparison with the human genome as a whole. These patterns may represent binding sites for proteins that confer STAR activity; in any case they form a set of sequence motifs that can be used to recognize STAR element sequences.

Using these patterns to recognize STAR elements by Discriminant Analysis, a high proportion of the elements obtained by the genetic screen of the invention are in fact classified as STARs. This reflects underlying sequence and functional similarities among these elements. An important aspect of the method described here (pattern frequency analysis followed by Discriminant Analysis) is that it can be reiterated; for example, by including the 19 candidate STAR elements of Table 9 with the 66 STAR elements of Table 6 into one training set, an improved discriminant model can be trained. This improved model can then be used to classify other candidate regulatory elements as STARs. Large-scale in vivo screening of genomic sequences using the method of the invention, combined with reiteration of the bio-informatic analysis, will provide a means of discriminating STAR elements that asymptotically approaches 100% recognition and prediction of elements as the genome is screened in its entirety. These stringent and comprehensive predictions of STAR function will ensure that all human STAR elements are recognized, and are available for use in improving transgene expression.

Example 14

Cloning and Characterization of STAR Elements from *Arabidopsis thaliana*

Transgene silencing occurs in transgenic plants at both the transcriptional and post-transcriptional levels (Meyer, 2000, Vance & Vaucheret, 2001). In either case, the desired result of transgene expression can be compromised by silencing; the low expression and instability of the transgene results in poor expression of desirable traits (e.g., pest resistance) or low yields of recombinant proteins. It also results in poor predictability: the proportion of transgenic plants that express the transgene at biotechnologically useful levels is low, which necessitates laborious and expensive screening of transformed individuals for those with beneficial expression characteristics. This example describes the isolation of STAR elements from the genome of the dicot plant *Arabidopsis thaliana* for use in preventing transcriptional transgene silencing in transgenic plants. *Arabidopsis* was chosen for this example because it is a well-studied model organism: it has a compact genome, it is amenable to genetic and recombinant DNA manipulations, and its genome has been sequenced (Bevan et al., 2001, Initiative, 2000, Meinke et al., 1998).

Materials and Methods:

Genomic DNA was isolated from *Arabidopsis thaliana* ecotype Columbia as described (Stam et al., 1998) and partially digested with MboI. The digested DNA was size-fractionated to 0.5-2 kilobase pairs by agarose gel electrophoresis and purification from the gel (QIAquick® Gel Extraction Kit, QIAGEN® 28706), followed by ligation into the pSelect vector (supra). Transfection into the U-2 OS/Tet-Off/LexA-HP1 cell line and selection for zeocin resistance at low doxycycline concentration was performed as described (supra). Plasmids were isolated from zeocin resistant colonies and re-transfected into the U-2 OS/Tet-Off/LexA-HP1 cell line.

Sequencing of *Arabidopsis* genomic DNA fragments that conferred zeocin resistance upon re-transfection was performed as described (supra). The DNA sequences were compared to the sequence of the *Arabidopsis* genome by BLAST analysis ((Altschul et al., 1990); URL WorldWideWeb.ncbi.nlm.nih.gov/blast/Blast).

STAR activity was tested further by measuring mRNA levels for the hygromycin- and zeocin-resistance genes in recombinant host cells by reverse transcription PCR (RT- PCR). Cells of the U-2 OS/Tet-Off/lexA-HP1 cell line were transfected with pSelect plasmids containing *Arabidopsis* STAR elements, the *Drosophila* scs element, or containing no insert (supra). These were cultivated on hygromycin for two weeks at high doxycycline concentration, then the doxycycline concentration was lowered to 0.1 ng/ml to induce the lexA-HP1 repressor protein. After ten days, total RNA was isolated by the RNeasy mini kit (QIAGEN® 74104) as described by the manufacturer. First-strand cDNA synthesis was carried out using the RevertAid™ First Strand cDNA Synthesis kit (MBI Fermentas 1622) using oligo(dT) 18 primer as described by the manufacturer. An aliquot of the cDNA was used as the template in a PCR reaction using primers D58 (SEQ ID NO:151) and D80 (SEQ ID NO:154) (for the zeocin marker), and D70 (SEQ ID NO:152) and D71 (SEQ ID NO:153) (for the hygromycin marker), and Taq DNA polymerase (Promega M2661). The reaction conditions were 15-20 cycles of 94° C. for one minute, 54° C. for one minute, and 72° C. for 90 seconds conditions result in a linear relationship between input RNA and PCR product DNA. The PCR products were resolved by agarose gel electrophoresis, and the zeocin and hygromycin bands were detected by Southern blotting as described (Sambrook et al., 1989), using PCR products produced as above with purified pSelect plasmid as template. The ratio of the zeocin and hygromycin signals corresponds to the normalized expression level of the zeocin gene.

Results

The library of *Arabidopsis* genomic DNA in the pSelect vector comprised 69,000 primary clones in *E. coli*, 80% of which carried inserts. The average insert size was approximately 1000 base pairs; the library, therefore, represents approximately 40% of the *Arabidopsis* genome.

A portion of this library (representing approximately 16% of the *Arabidopsis* genome) was transfected into the U-2 OS/Tet-Off/LexA-HP1 cell line. Hygromycin selection was imposed to isolate transfectants, which resulted in 27,000 surviving colonies. These were then subjected to zeocin selection at low doxycycline concentration. Putative STAR-containing plasmids from 56 zeocin-resistant colonies were rescued into *E. coli* and re-transfected into U-2 OS/Tet-Off/LexA-HP1 cells. Forty-four of these plasmids (79% of the plasmids tested) conferred zeocin resistance on the host cells at low doxycycline concentrations, demonstrating that the plasmids carried STAR elements. This indicates that the pSelect screen in human U-2 OS cells is highly efficient at detection of STAR elements from plant genomic DNA.

The DNA sequences of these 44 candidate STAR elements were determined. Thirty-five of them were identified as single loci in the database of *Arabidopsis* nuclear genomic sequence (Table 10; SEQ ID NO:85-SEQ ID NO:119). Four others were identified as coming from the chloroplast genome, four were chimeras of DNA fragments from two loci, and one was not found in the *Arabidopsis* genome database.

Figure 22:
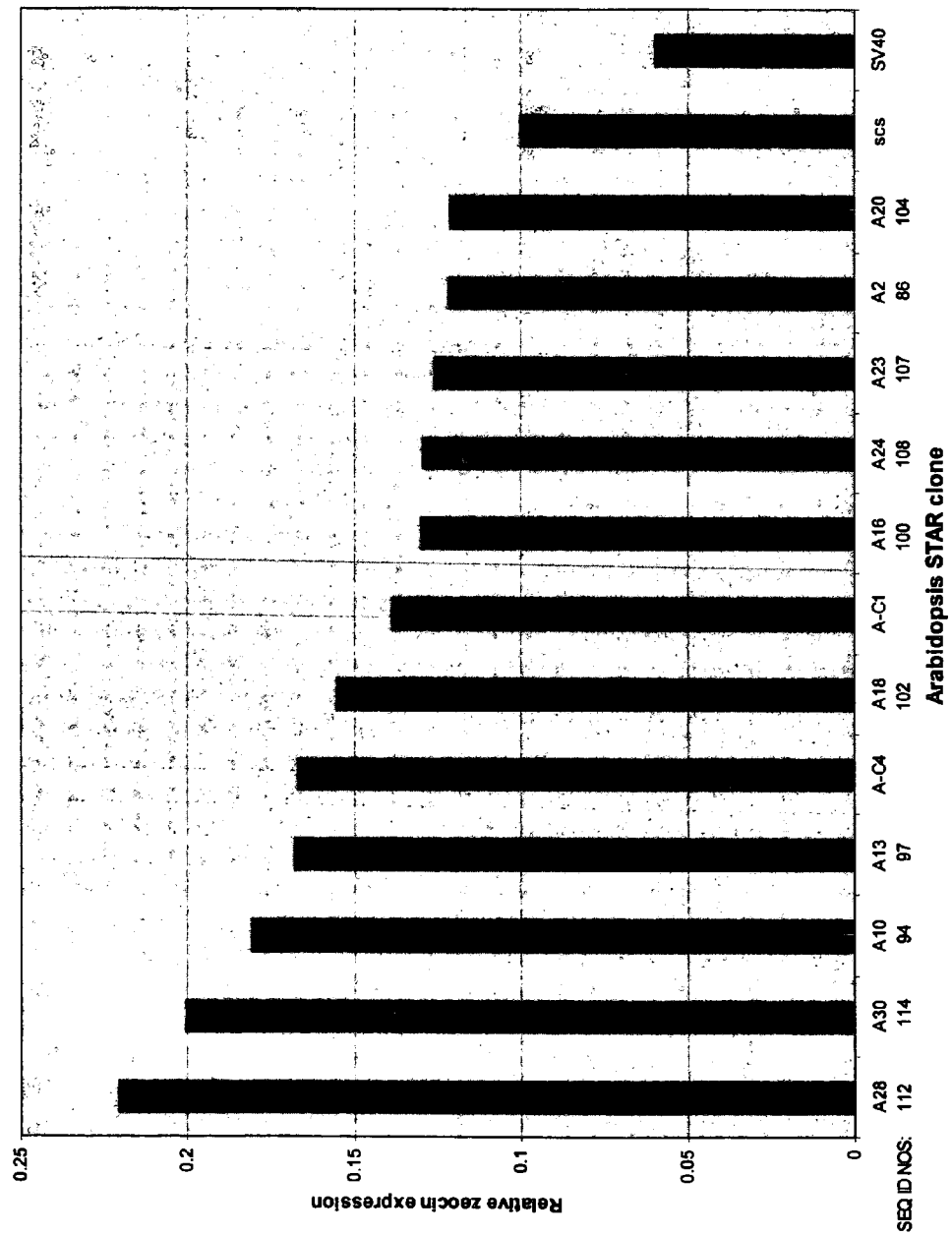
FIG. 22 is a graph depicting the RT-PCR assay of *Arabidopsis* STAR strength. U-2 OS/Tet-Off/lexA-HP1 cells were transfected with candidate *Arabidopsis* STAR elements and cultivated at low doxycycline concentrations. Total RNA was isolated and subjected to RT-PCR; the bands corresponding to the zeocin and hygromycin resistance mRNAs were detected by Southern blotting and quantified with a phosphorimager. The ratio of the zeocin to hygromycin signals is shown for transfectants containing zeocin expression units flanked by 12 different *Arabidopsis* STAR elements, the *Drosophila* scs element, or no flanking element.

The strength of the cloned *Arabidopsis* STAR elements was tested by assessing their ability to prevent transcriptional repression of the zeocin-resistance gene, using an RT-PCR assay. As a control for RNA input among the samples, the transcript levels of the hygromycin-resistance gene for each STAR transfection were assessed too. This analysis has been performed for 12 of the *Arabidopsis* STAR elements. The results (FIG. 22) demonstrate that the *Arabidopsis* STAR elements are superior to the *Drosophila* scs element (positive control) and the empty vector ("SV40"; negative control) in their ability to protect the zeocin-resistance gene from transcriptional repression. In particular, STAR-A28 (SEQ ID NO:112) and STAR-A30 (SEQ ID NO:114) enable 2-fold higher levels of zeocin-resistance gene expression than the scs element (normalized to the internal control of hygromycin-resistance gene mRNA) when the lexA-HP1 repressor is expressed.

These results demonstrate that the method of the invention can be successfully applied to recovery of STAR elements from genomes of other species than human. Its successful application to STAR elements from a plant genome is particularly significant because it demonstrates the wide taxonomic range over which the method of the invention is applicable, and because plants are an important target of biotechnological development.

Example 15

STAR-shielded Genes that Reside on Multiple Vectors are Expressed Simultaneously in CHO Cells STAR elements function to block the effect of transcriptional repression influences on transgene expression units. One of the benefits of STAR elements for heterologous protein production is the increased predictability of finding high-expressing primary recombinant host cells. This feature allows for the simultaneous expression of different genes that reside on multiple, distinct vectors. In this example, we use two different STAR7-shielded (SEQ ID NO:7) genes, GFP and RED, which are located on two different vectors. When these two vectors are transfected simultaneously to Chinese hamster ovary (CHO) cells, both are expressed, whereas the corresponding, but unprotected GFP and RED genes, show hardly such simultaneous expression.

Material and Methods

The STAR7 element (SEQ ID NO:7) is tested in the ppGIZ-STAR7 and ppRIP-STAR7 vectors (FIG. 23). The construction of the pPlug&Play (ppGIZ and ppRIP) vectors is described below. Plasmid pGFP (Clontech 6010-1) is modified by insertion of a linker at the BsiWI site to yield pGFP-link. The linker (made by annealing oligonucleotides 5'GTACGGATATCAGATCTTTAATTAAG3' (SEQ ID NO:124) and 5'GTACCTTAATTAAAGATCTGATATCC3' (SEQ ID NO:125)) introduces sites for the PacI, BglII, and EcoRV restriction endonucleases. This creates the multiple cloning site MCSII for insertion of STAR elements. Then primers (5'GATCAGATCTGGCGCGCCATTTAAATCG TCTCGCGCGTTTCGGTGATGACGG3' (SEQ ID NO:126)) and (5'AGGCGGATCCGA ATGTATTTA-GAAAAATAAACAAA TAGGGG3' (SEQ ID NO:127)) are used to amplify a region of 0.37 kb from pGFP, which is inserted into the BglII site of pIRES (Clontech 6028-1) to yield pIRES-stuf. This introduces sites for the AscI and SwaI restriction endonucleases at MCSI, and acts as a "stuffer fragment" to avoid potential interference between STAR elements and adjacent promoters. pIRES-stuf is digested with BglII and FspI to liberate a DNA fragment composed of the stuffer fragment, the CMV promoter, the IRES element (flanked by multiple cloning sites MCS A and MCS B), and the SV40 polyadenylation signal. This fragment is ligated with the vector backbone of pGFP-link produced by digestion with BamHI and StuI, to yield pIRES-link.

The open reading frames of the zeocin-resistance gene are inserted into the BamHI/NotI sites of MCS B in pIRES-link as follows: the zeocin-resistance ORF is amplified by PCR with primers 5'GATCGGATCCTTCGAAATGGCCAAGT-TGACCAGTGC3' (SEQ ID NO:128) and 5'AGGCGCG-GCCGCAATTCTCAGTCCTGCTCCTC3' (SEQ ID NO:129) from plasmid pEM7/zeo, digested with BamHI and NotI, and ligated with BamHI/NotI-digested pIRES-link to yield pIRES-link-zeo. The GFP reporter ORF is introduced into pIRES-link-zeo by amplification of phr-GFP-1 with primers 5'GATCGAATTCTCGCGAATGGTGAGCAAGC AGATCCTGAAG3' (SEQ ID NO:130) and 5'AGGCGAAT-TCACCGGTGTTTAAACTTAC ACCCACTCGTGCAG-GCTGCCCAGG3' (SEQ ID NO:131), and insertion of the EcoRI-digested GFP cassette into the EcoRI site in MCS A of the pIRES-link-zeo plasmid. This creates the ppGIZ (for ppGFP-IRES-zeo). 5' STAR7 (SEQ ID NO:7) is cloned into the SalI site and 3' STAR7 (SEQ ID NO:7) is cloned into the PacI site.

The puromycin-resistance ORF is amplified by PCR with primers 5'GATCGGATCCTTCGAAATGACCGAGTA-CAAGCCCACG3' (SEQ ID NO:132) and 5'AGGCGCG-GCCGCTCAGGCACCGGGCTTGCGGGTC3' (SEQ ID NO:133) from plasmid pBabe-Puro (Morgenstern & Land, 1990), digested with BamHI and NotI, and ligated with BamHI/NotI-digested pIRES-link to yield pIRES-link-puro. The RED gene is amplified by PCR with primers 5'GATCTCTAGATCGCGAATGGCCTCCTC-CGAGAACGTCATC3' (SEQ ID NO:134) and 5'AGGCACGCGTTCGCGACTACAGGAACAG-GTGGTGGCG3' (SEQ ID NO:135) from plasmid pDsRed2 (Clontech 6943-1), digested with XbaI and MluI and ligated to NheI-MluI digested pIRES-link-puro to yield ppRIP (for ppRED-IRES-puro). 5' STAR7 (SEQ ID NO:7) is cloned into the SalI site and 3' STAR7 (SEQ ID NO:7) is cloned into the PacI site.

Transfection and Culture of CHO Cells

The Chinese Hamster Ovary cell line CHO-K1 (ATCC CCL-61) is cultured in HAMS-F12 medium+10% Fetal Calf Serum containing 2 mM glutamine, 100 U/ml penicillin, and 100 micrograms/ml streptomycin at 37° C./5% $CO_2$. Cells are transfected with the plasmids using Lipofectamine™ 2000 (Invitrogen) as described by the manufacturer. Briefly, cells are seeded to culture vessels and grown overnight to 70-90% confluence. Lipofectamine reagent is combined with plasmid DNA at a ratio of 7.5 microliters per 3 microgram (e.g., for a 10 cm Petri dish, 20 micrograms DNA and 120 microliters Lipofectamine) and added after 30 minutes incubation at 25° C. to the cells. After six hours incubation, the transfection mixture is replaced with fresh medium, and the transfected cells are incubated further. After overnight cultivation, cells are trypsinized and seeded into fresh petri dishes with fresh medium with zeocin added to a concentration of 100 μg/ml and the cells are cultured further. When individual colonies become visible (approximately ten days after transfection) medium is removed and replaced with fresh medium (puromycin).

Individual colonies are isolated and transferred to 24-well plates in medium with zeocin. Expression of the GFP and RED reporter genes is assessed approximately three weeks after transfection.

One tested construct consists of a monocistronic gene with the GFP gene, an IRES and the Zeocin resistance gene under control of the CMV promoter, but either with or without STAR7 element (SEQ ID NO:7) to flank the entire construct (FIG. 23). The other construct consists of a monocistronic gene with the RED gene, an IRES and the puromycin resistance gene under control of the CMV promoter, but either with or without STAR7 element (SEQ ID NO:7) to flank the entire construct (FIG. 23).

The constructs are transfected to CHO-K1 cells. Stable colonies that are resistant for both zeocin and puromycin are expanded before the GFP and RED signals are determined on a XL-MCL Beckman Coulter flow cytometer. The percentage of cells in one colony that are double positive for both GFP and RED signals is taken as measure for simultaneous expression of both proteins and this is plotted in FIG. 23.

Results

FIG. 23 shows that simultaneous expression in independent zeocin and puromycin resistant CHO colonies of GFP and a RED reporter genes that are flanked by a STAR element results in a higher number of cells that express both GFP and RED proteins, as compared to the control vectors without STAR7 element (SEQ ID NO:7). The STAR7 element (SEQ ID NO:7), therefore, conveys a higher degree of predictability of transgene expression in CHO cells. In the STAR-less colonies at most nine out of 20 colonies contain double GFP/RED positive cells. The percentage of double positive cells ranges between 10 and 40%. The remaining 11 out of 20 colonies have less than 10% GFP/RED positive cells. In contrast, in 19 out of 20 colonies that contain the STAR-shielded GFP and RED genes, the percentage GFP/RED double positive cells ranges between 25 and 75%. In 15 out of these 19 double positive colonies the percentage GFP/RED double positive cells is higher than 40%. This result shows that it is more likely that simultaneous expression of two genes is achieved when these genes are flanked with STAR elements.

Example 16

Expression of a Functional Antibody from two Separate Plasmids is More Easily Obtained When STAR Elements Flank the Genes Encoding the Heavy and Light Chains Due to the ability of STAR elements to convey higher predictability to protein expression two genes can be expressed simultaneously from distinct vectors. This is shown in Example 15 for two reporter genes, GFP and RED. Now the simultaneous expression of a light and a heavy antibody chain is tested. In Example 16, STAR7-shielded light and heavy antibody cDNAs that reside on distinct vectors are simultaneously transfected to Chinese hamster ovary cells. This results in the production of functional antibody, indicating that both heavy and light chains are expressed simultaneously. In contrast, the simultaneous transfection of unprotected light and heavy antibody cDNAs shows hardly any expression of functional antibody.

Materials and Methods

The tested constructs are the same as described in Example 15, except that the GFP gene is replaced by the gene encoding the light chain of the RING1 antibody (Hamer et al., 2002) and the RED gene is replaced by the gene encoding the heavy chain of the RING1 antibody. The light chain is amplified from the RING1 hybridoma (Hamer et al., 2002) by RT-PCR using the primers 5'CAAGAAT-TCAATGGATTTTCAAGTGCAG3' (SEQ ID NO:136) and 5'CAAGCGGCCGCTTTGTCTCTAACACTCATTCC3' (SEQ ID NO:137). The PCR product is cloned into pcDNA3 after restriction digestion with EcoRI and NotI and sequenced to detect potential frame shifts in the sequence. The cDNA is excised with EcoRI and NotI, blunted and cloned in ppGIZ plasmid. The heavy chain is amplified from the RING1 hybridoma (Hamer et al., 2002) by RT-PCR using the primers 5'ACAGAATTCTTACCATG-GATTTTGGGCTG3' (SEQ ID NO:138) and 5'ACAGCG-GCCGCTCATTTACCAGGAGAGTGGG3' (SEQ ID NO:139). The PCR product is cloned into pcDNA3 after restriction digestion with EcoRI and NotI and sequenced to detect potential frame shifts in the sequence. The cDNA is excised with EcoRI and NotI, blunted and cloned in ppRIP plasmid.

Results

Figure 24:
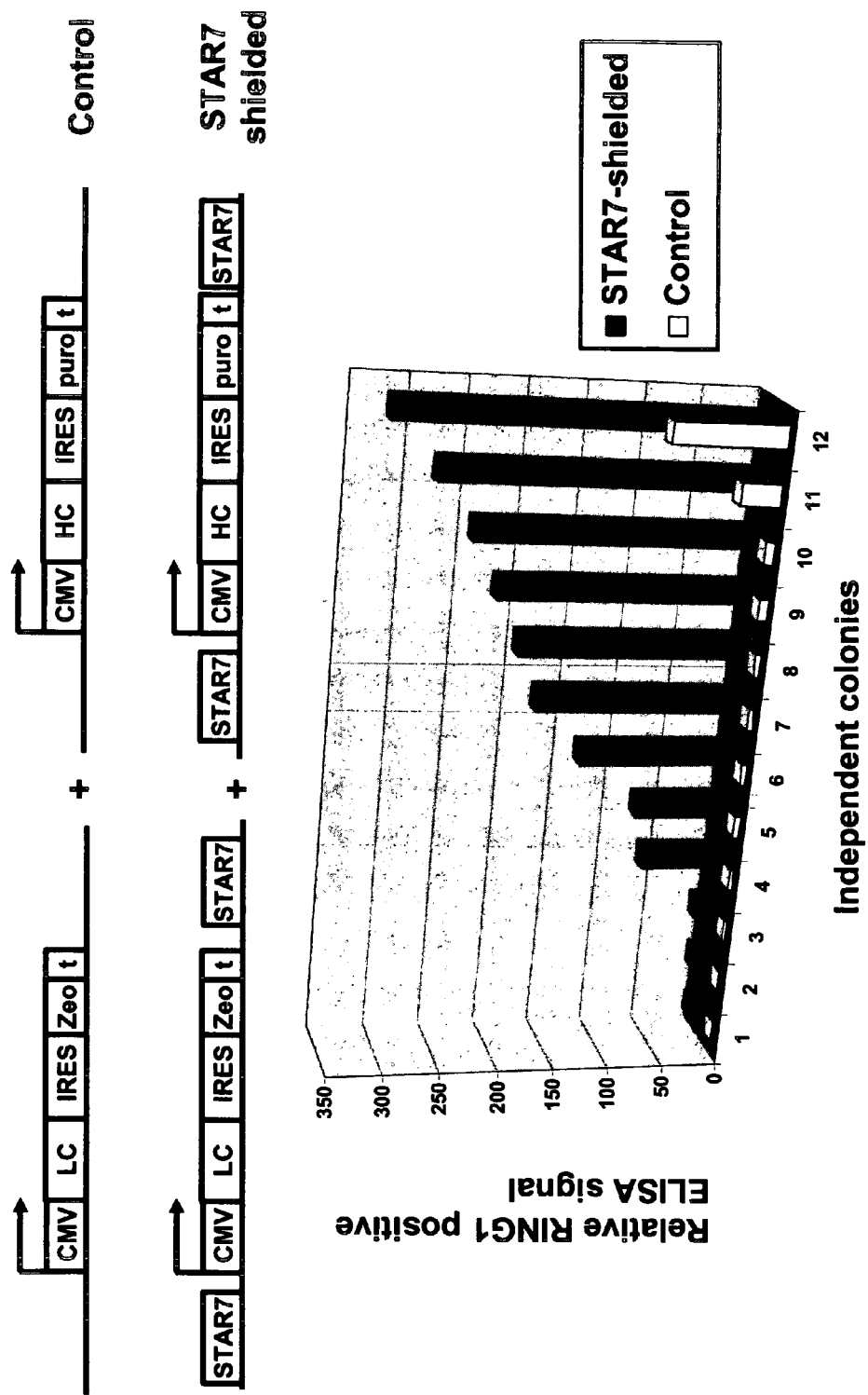
FIG. 24 also includes schematic diagrams and a graph illustrating that STAR elements improve expression of a functional antibody in CHO cells. The different vectors containing the Light and Heavy Chain of the RING1 antibody are shown in FIG. 24. The constructs are simultaneously transfected to CHO cells. Stable colonies that are resistant to both zeocin and puromycin are expanded. The cell culture medium of these colonies is tested for the detection of functional RING1 antibody in an ELISA with RING1 protein as antigen. The values are dividing by the number of cells in the colony. The highest value detected in the STAR-less control is arbitrarily set at 100%.

CHO colonies are simultaneously transfected with the RING1 Light Chain (LC) and RING1 Heavy Chain (HC) cDNAs that reside on two distinct vectors. The Light Chain is coupled to the zeocin resistance gene through an IRES, the Heavy Chain is coupled to the puromycin resistance gene through an IRES. FIG. 24 shows that simultaneous transfection to CHO cells of the heavy and light chain encoding cDNAs results in the establishment of independent zeocin and puromycin resistant colonies. When the constructs are flanked by the STAR7 element (SEQ ID NO:7), this results in a higher production of functional RING1 antibody, as compared to the control vectors without STAR7 element (SEQ ID NO:7). The STAR7 element (SEQ ID NO:7), therefore, conveys a higher degree of predictability of antibody expression in CHO cells.

In the STAR-less colonies only one out of 12 colonies express detectable antibody. In contrast, seven out of twelve colonies that contain the STAR-shielded Light and Heavy Chain genes produce functional RING1 antibody that detects the RING1 antigen in an ELISA assay. Significantly, all these seven colonies produce higher levels of RING1 antibody than the highest control colony (arbitrarily set at 100%). This result shows that it is more likely that simultaneous expression of two genes encoding two antibody chains is achieved when these genes are flanked with STAR elements.

TABLE 1

Oligonucleotides used for polymerase chain reactions (PCR primers) or DNA mutagenesis (SEQ ID NOS: 140-207).

| SEQ ID NO: | Number | Sequence |
|---|---|---|
| 140 | C65 | AACAAGCTTGATATCAGATCTGCTAGCTTGGTCGAGCTGATACTTCCC |
| 141 | C66 | AAACTCGAGCGGCCGCGAATTCGTCGACTTTACCACTCCCTATCAGTGATAGAG |
| 142 | C67 | AAACCGCGGCATGGAAGACGCCAAAAACATAAAGAAAGG |
| 143 | C68 | TATGGATCCTAGAATTACACGGCGATCTTTCC |
| 144 | C81 | AAACCATGGCCGAGTACAAGCCCACGGTGCGCC |
| 145 | C82 | AAATCTAGATCAGGCACCGGGCTTGCGGGTCATGC |
| 146 | C85 | CATTTCCCCGAAAAGTGCCACC |
| 147 | D30 | TCACTGCTAGCGAGTGGTAAACTC |
| 148 | D41 | GAAGTCGACGAGGCAGGCAGAAGTATGC |
| 149 | D42 | GAGCCGCGGTTTAGTTCCTCACCTTGTCG |
| 150 | D51 | TCTGGAAGCTTTGCTGAAGAAAC |

TABLE 1-continued

Oligonucleotides used for polymerase chain reactions (PCR primers) or DNA mutagenesis (SEQ ID NOS: 140-207).

| SEQ ID NO: | Number | Sequence |
|---|---|---|
| 151 | D58 | CCAAGTTGACCAGTGCC |
| 152 | D70 | TACAAGCCAACCACGGCCT |
| 153 | D71 | CGGAAGTGCTTGACATTGGG |
| 154 | D80 | GTTCGTGGACACGACCTCCG |
| 155 | D89 | GGGCAAGATGTCGTAGTCAGG |
| 156 | D90 | AGGCCCATGGTCACCTCCATCGCTACTGTG |
| 157 | D91 | CTAATCACTCACTGTGTAAT |
| 158 | D93 | AATTACAGGCGCGCC |
| 159 | D94 | AATTGGCGCGCCTGT |
| 160 | D95 | TGCTTTGCATACTTCTGCCTGCCTC |
| 161 | E12 | TAGGGGGGATCCAAATGTTC |
| 162 | E13 | CCTAAAAGAAGATCTTTAGC |
| 163 | E14 | AAGTGTTGGATCCACTTTGG |
| 164 | E15 | TTTGAAGATCTACCAAATGG |
| 165 | E16 | GTTCGGGATCCACCTGGCCG |
| 166 | E17 | TAGGCAAGATCTTGGCCCTC |
| 167 | E18 | CCTCTCTAGGGATCCGACCC |
| 168 | E19 | CTAGAGAGATCTTCCAGTAT |
| 169 | E20 | AGAGTTCCGGATCCGCCTGG |
| 170 | E21 | CCAGGCAGACTCGGAACTCT |
| 171 | E22 | TGGTGAAACCGGATCCCTAC |
| 172 | E23 | AGGTCAGGAGATCTAGACCA |
| 173 | E25 | CCATTTTCGCTTCCTTAGCTCC |
| 174 | E42 | CGATGTAACCCACTCGTGCACC |
| 175 | E57 | AGAGATCTAGGATAATTTCG |
| 176 | E84 | GATCTCTAGAATGGCCAAGCCTTTGTCTCAAG |
| 177 | E85 | AGGCGCGGCCGCTTAGCCCTCCCACACATAACCAGAG |
| 178 | E87 | AGGCACGCGTTCATGTCTGCTCGAAGCGGCC |
| 179 | E92 | AGGCGCTAGCACGCGTTCTACTCTTTTCCTACTCTG |
| 180 | E93 | GATCAAGCTTACGCGTCTAAAGGCATTTTATATAG |
| 181 | E94 | AGGCGCTAGCACGCGTTCAGAGTTAGTGATCCAGG |
| 182 | E95 | GATCAAGCTTACGCGTCAGTAAAGGTTTCGTATGG |
| 183 | E96 | AGGCGCTAGCACGCGTTCTACTCTTTCATTACTCTG |
| 184 | E97 | CGAGGAAGCTGGAGAAGGAGAAGCTG |
| 185 | E98 | CAAGGGCCGCAGCTTACACATGTTC |
| 186 | E99 | GATCACTAGTATGGCCAAGTTGACCAGTGC |

TABLE 1-continued

Oligonucleotides used for polymerase chain reactions (PCR primers) or DNA mutagenesis (SEQ ID NOS: 140-207).

| SEQ ID NO: | Number | Sequence |
|---|---|---|
| 187 | E100 | AGGCGCGGCCGCAATTCTCAGTCCTGCTCCTC |
| 188 | F11 | GATCGCTAGCAATCGCGACTTCGCCCACCATGC |
| 189 | F14 | GATCGAATTCTCGCGACTTCGCCCACCATGC |
| 190 | F15 | AGGCGAATTCACCGGTGTTTAAACTCATGTCTGCTCGAAGCGGCCGG |
| 191 | F16 | GATCGAATTCTCGCGAATGGTGAGCAAGCAGATCCTGAAG |
| 192 | F17 | AGGCGAATTCACCGGTGTTTAAACTTACACCCACTCGTGCAGGCTGCCCAGG |
| 193 | F18 | GATCGGATCCTTCGAAATGGCCAAGTTGACCAGTGC |
| 194 | F19 | GATCGGATCCTTCGAAATGATTGAACAAGATGGATTGC |
| 195 | F20 | AGGCGCGGCCGCTCAGAAGAACTCGTCAAGAAGGCG |
| 196 | F21 | GATCGGATCCTTCGAAATGACCGAGTACAAGCCCACG |
| 197 | F22 | AGGCGCGGCCGCTCAGGCACCGGGCTTGCGGGTC |
| 198 | F23 | GATCAGATCTGGCGCGCCATTTAAATCGTCTCGCGCGTTTCGGTGATGACGG |
| 199 | F24 | AGGCGGATCCGAATGTATTTAGAAAAATAAACAAATAGGGG |
| 200 | F25 | GTACGGATATCAGATCTTTAATTAAG |
| 201 | F26 | GTACCTTAATTAAAGATCTGATATCC |
| 202 | F32 | GATCGAGGTACCGGTGTGT |
| 203 | F33 | GATCACACACCGGTACCTC |
| 204 | F34 | CGGAGGTACCGGTGTGT |
| 205 | F35 | CGACACACCGGTACCTC |
| 206 | F44 | TGAGAGGTACCGGTGTGT |
| 207 | F45 | TCAACACACCGGTACCTC |

TABLE 2

STAR elements and two-step selection increase the predictability of transgene expression

|  | without STAR | fold improvement | with STAR |
|---|---|---|---|
| (carry out first antibiotic selection) | | | |
| Number colonies[1] | ~100 | 10-fold | ~1000 |
| High producers | | | |
| percent | 5% | 3-fold | 15% |
| number (characterize 20 colonies) | 5 (20% of population) | | 150 (2% of population) |
| High producers | 1 | 3-fold[2] | 3 |
| Low producers (carry out second antibiotic selection, killing low producers) | 19 | | 17 |
| Survivors to characterize | 5 | 30-fold[3] | 150 |

[1]Colonies per microgram plasmid DNA.
[2]Manifesting the three-fold improvement due to the presence of STARs in the percent of high producers in the original population of colonies resistant to the first antibiotic.
[3]Manifesting the arithmetic product of the fold improvement in the number of colonies and the increased percentage of high producers due to the presence of STARs.

TABLE 3

Sequences of various STAR elements (SEQ ID NOS: 208-217)

STAR3 forward (SEQ ID NO: 208)
ACGTNCTAAGNAAACCATTATTATCATGACATTAACCTATAAAAATAGGCGTATCAC

GAGGCCCTTTCGTCTTCACTCGAGCGGCCAGCTTGGATCTCGAGTACTGAAATAGGA

GTAAATCTGAAGAGCAAATAAGATGAGCCAGAAAACCATGAAAAGAACAGGGACT

ACCAGTTGATTCCACAAGGACATTCCCAAGGTGAGAAGGCCATATACCTCCACTACC

TGAACCAATTCTCTGTATGCAGATTTAGCAAGGTTATAAGGTAGCAAAAGATTAGAC

CCAAGAAAATAGAGAACTTCCAATCCAGTAAAAATCATAGCAAATTTATTGATGAT

AACAATTGTCTCCAAAGGAACCAGGCAGAGTCGTGCTAGCAGAGGAAGCACGTGAG

TABLE 3-continued

Sequences of various STAR elements (SEQ ID NOS: 208-217)

CTGAAAACAGCCAAATCTGCTTTGTTTTCATGACACAGGAGCATAAAGTACACACCA

CCAACTGACCTATTAAGGCTGTGGTAAACCGATTCATAGAGAGAGGTTCTAAATACA

TTGGTCCCTCATAGGCAAACCGCAGTTCACTCCGAACGTAGTCCCTGGAAATTTGAT

GTCCAGNATAGAAAAGCANAGCAGNCNNNNNNTATANATNNNGNTGANCCANATG

NTNNCTGNNC

STAR3 reverse (SEQ ID NO: 209)
GAGCTAGCGGCGCGCCAAGCTTGGATCCCGCCCCGCCCCCTCCGCCCTCGAGCCCCG

CCCCTTGCCCTAGAGGCCCTGCCGAGGGGCGGGGCCTGTCCCTCCTCCCCTTTCCCC

CGCCCCCTACCGTCACGCTCAGGGGCAGCCTGACCCCGAGCGGCCCCGCGGTGACC

CTCGCGCAGAGGCCTGTGGGAGGGCGTCGCAAGCCCTGAATCCCCCCCGTCTGT

TCCCCCCTCCCGCCCAGTCTCCTCCCCCTGGGAACGCGCGGGGTGGGTGACAGACCT

GGCTGCGCGCCACCGCCACCGCGCCTGCCGGGGGCGCTGCCGCTGCCTGAGAAACT

GCGGCTGCCGCCTGGAGGAGGTGCCGTCGCCTCCGCCACCGCTGCCGCCGCCGCCA

GGGGTAGGAGCTAAGCCGCCGCCATTTTGTGTCCCCCTGTTGTTGTCGTTGACATGA

ATCCGACATGACACTGATTACAGCCCAATGGAGTCTCATTAAACCCGAGTCGCGGTC

CCGCCCCGCCGCTGCTCCATTGGAGGAGACCAAAGACACTTAAGGCCACCCGTTGG

CCTACGGGTCTGTCTGTCACCCACTCACTAACCACTCTGCAGCCCATTGGGGCAGGT

TCCTGCCGGTCATNTCGCTTCCAATAAACACACCCCTTCGACCCCATNATTCCCCCCC

TTCGGGAACCACCCCCGGGGAGGGGTCCACTGGNCAATACCAATTNAANAGAACC

GCTNGGGTCCGCCTNTTTNCGGGCNCCCTATTGGGTT

STAR4 forward (SEQ ID NO: 210)
GGGGAGGATTCTTTTGGCTGCTGAGTTGAGATTAGGTTGAGGGTAGTGAAGGTAAA

GGCAGTGAGACCACGTAGGGGTCATTGCAGTAATCCAGGCTGGAGATGATGGTGGT

TCAGTTGGAATAGCAGTGCATGTGCTGTAACAACCTCAGCTGGGAAGCAGTATATGT

GGCGTTATGACCTCAGCTGGAACAGCAATGCATGTGGTGGTGTAATGACCCCAGCTG

GGTAGGGTGCATGTGATGGAACAACCTCAGCTGGGTAGCAGTGTACTTGATAAAAT

GTTGGCATACTCTACATTTGTTATGAGGGTAGTGCCATTAAATTTCTCCACAAATTGG

TTGTCACGTATGAGTGAAAAGAGGAAGTGATGGAAGACTTCAGTGCTTTTGGCCTGA

ATAAATAGAAGACGTCATTTTCAGTAATGGAGACAGGGAAGACTAANGNAGGGTGG

ATTCAGTAGAGCAGGTGTTCAGTTTTGAATATGATGAACTCTGAGAGAGGAAAAAC

TTTTTCTACCTCTTAGTTTTTGNGNCTGGACTTAANATTAAAGGACATANGACNGAG

ANCAGACCAAATNTGCGANGTTTTTATATTTTACTTGCNGAGGGAATTTNCAAGAAA

AAGAAGACCCAANANCCATTGGTCAAAACTATNTGCCTTTTAANAAAAAGANAATT

ACAATGGANANANAAGTGTTGNCTNGGCAAAAATTGGG

STAR4 reverse (SEQ ID NO: 211)
GGATTNGAGCTAGCGGCGCGCCAAGCTTGGATCTTAGAAGGACAGAGTGGGGCATG

GAAATGCACCACCAGGGCAGTGCAGCTTGGTCACTGCCAGCTCCNCTCATGGGCAG

AGGGCTGGCCTCTTGCAGCCGACCAGGCACTGAGCGCCATCCCAGGGCCCTCGCCA

GCCCTCAGCAGGGCCAGGACACACAAGCCTTTGACTTCCTCCTGTCACTGCTGCTGC

CATTCCTGTTTTGTGGTCATCACTCCTTCCCTGTCCTCAGACTGCCCAGCACTCAAGG

TABLE 3-continued

Sequences of various STAR elements (SEQ ID NOS: 208-217)

ATGTCCTGTGGTGGCATCAGACCATATGCCCCTGAANAGGAGTGAGTTGGTGTTTTT

TGCCGCGCCCANAGAGCTGCTGTCCCCTGAAAGATGCAAGTGGGAATGATGATGNT

CACCATCNTCTGACACCAAGCCCTTTGGATAGAGGCCCCAACAGTGAGGATGGGGC

TGCACTGCATTGCCAAGGCAACTCTGTNNTGACTGCTACANGACANTCCCAGGACCT

GNGAAGNNCTATANATNTGATGCNAGGCACCT

STAR6 forward (SEQ ID NO: 212)
CCACCACAGACATCCCCTCTGGCCTCCTGAGTGGTTTCTTCAGCACAGCTTCCAGAG

CCAAATTAAACGTTCACTCTATGTCTATAGACAAAAAGGGTTTTGACTAAACTCTGT

GTTTTAGAGAGGGAGTTAAATGCTGTTAACTTTTTAGGGGTGGGCGAGAGGAATGA

CAAATAACAACTTGTCTGAATGTTTTACATTTCTCCCCACTGCCTCAAGAAGGTTCAC

AACGAGGTCATCCATGATAAGGAGTAAGACCTCCCAGCCGGACTGTCCCTCGGCCC

CCAGAGGACACTCCACAGAGATATGCTAACTGGACTTGGAGACTGGCTCACACTCC

AGAGAAAAGCATGGAGCACGAGCGCACAGAGCANGGGCCAAGGTCCCAGGGACNG

AATGTCTAGGAGGGAGATTGGGGTGAGGGTANTCTGATGCAATTACTGNGCAGCTC

AACATTCAAGGGAGGGGAAGAAAGAAACNGTCCCTGTAAGTAAGTTGTNCANCAGA

GATGGTAAGCTCCAAATTTNAACTTTGGCTGCTGGAAAGTTTNNGGGCCNANANAA

NAAACANAAANATTTGAGGTTTANACCCACTAACCCNTATNANTANTTATTAATACC

CCTAATTANACCTTGGATANCCTTAAAATATCNTNTNAAACGGAACCCTCNTTCCCN

TTTNNAAATNNNAAAGGCCATTNNGNNCNAGTAAAAATCTNNNTTAAGNNNTGGGC

CCNAACAAACNTNTTCCNAGACACNTTTTTTNTCCNGGNATTTNTAATTTATTTCTAA

NCC

STAR6 reverse (SEQ ID NO: 213)
ATCGTGTCCTTTCCAGGGACATGGATGAAGCTGGAAGCCATCATCCTCAGCAAACTA

ACACAGGAACAGAAAACCAAATACCACATGTTCTCACTCATAAGTGGGAGCTGAAC

AGTGAGAACACATGGACACAGGGAGGGGAACATCACACACCAAGGCCTGTCTGGTG

TGGGGAGGGGAGGGAGAGCATCAGGACAAATAGCTAATGCATGTGGGGCTTAAACC

TAGATGACGGGTTGATAGGTGCAGCAATCCACTATGGACACATATACCTATGTAACA

ACCCNACCTTNTTGACATGTATCCCAGAACTTAAAGGAAAATAAAAATTAAAAAAA

ATTNCCCTGGAATAAAAAAGAGTGTGGACTTTGGTGAGATN

STAR8 forward (SEQ ID NO: 214)
GGATCACCTCGAAGAGAGTCTAACGTCCGTAGGAACGCTCTCGGGTTCACAAGGAT

TGACCGAACCCCAGGATACGTCGCTCTCCATCTGAGGCTTGNTCCAAATGGCCCTCC

ACTATTCCAGGCACGTGGGTGTCTCCCCTAACTCTCCCTGCTCTCCTGAGCCCATGCT

GCCTATCACCCATCGGTGCAGGTCCTTTCTGAANAGCTCGGGTGGATTCTCTCCATC

CCACTTCCTTTCCCAAGAAAGAAGCCACCGTTCCAAGACACCCAATGGGACATTCCC

NTTCCACCTCCTTNTCNAAAGTTNGCCCAGGTGTTCNTAACAGGTTAGGGAGAGAAN

CCCCCAGGTTTNAGTTNCAAGGCATAGGACGCTGGCTTGAACACACACACACNCTC

STAR8 reverse (SEQ ID NO: 215)
GGATCCCGACTCTGCACCGCAAACTCTACGGCGCCCTGCAGGACGGCGGCCTCCTGC

CGCTTGGACGCCAGNCAGGAGCTCCCCGGCAGCAGCAGAGCAGAAAGAAGGATGG

CCCCGCCCCACTTCGCCTCCCGGCGGTCTCCCTCCCGCCGGCTCACGGACATAGATG

TABLE 3-continued

Sequences of various STAR elements (SEQ ID NOS: 208-217)

GCTGCCTAGCTCCGGAAGCCTAGCTCTTGTTCCGGGCATCCTAAGGAAGACACGGTT

TTTCCTCCCGGGGCCTCACCACATCTGGGACTTTGACGACTCGGACCTCTCTCCATTG

AATGGTTGCGCGTTCTCTGGGAAAG

STAR18 forward (SEQ ID NO: 216)
TGGATCCTGCCGCTCGCGTCTTAGTGTTTCTCCCTCAAGACTTTCCTTCTGTTTTGTTG

TCTTGTGCAGTATTTTACAGCCCCTCTTGTGTTTTTCTTTATTTCTCGTACACACACGC

AGTTTTAAGGGTGATGTGTGTATAATTAAAAGGACCCTTGGCCCATACTTTCCTAAT

TCTTTAGGGACTGGGATTGGGTTTGACTGAAATATGTTTTGGTGGGGATGGGACGGT

GGACTTCCATTCTCCCTAAACTGGAGTTTTGGTCGGTAATCAAAACTAAAAGAAACC

TCTGGGAGACTGGAAACCTGATTGGAGCACTGAGGAACAAGGGAATGAAAAGGCA

GACTCTCTGAACGTTTGATGAAATGGACTCTTGTGAAAATTAACAGTGAATATTCAC

TGTTGCACTGTACGAAGTCTCTGAAATGTAATTAAAAGTTTTTATTGAGCCCCCGAG

CTTTGGCTTGCGCGTATTTTTCCGGTCGCGGACATCCCACCGCGCAGAGCCTCGCCT

CCCCGCTGNCCTCAGCTCCGATGACTTCCCCGCCCCCGCCCTGCTCGGTGACAGACG

TTCTACTGCTTCCAATCGGAGGCACCCTTCGCGG

STAR18 reverse (SEQ ID NO: 217)
TGGATCCTGCCGCTCGCGTCTTAGTGTTTCTCCCTCAAGACTTTCCTTCTGTTTTGTTG

TCTTGTGCAGTATTTTACAGCCCCTCTTGTGTTTTTCTTTATTTCTCGTACACACACGC

AGTTTTAAGGGTGATGTGTGTATAATTAAAAGGACCCTTGGCCCATACTTTCCTAAT

TCTTTAGGGACTGGGATTGGGTTTGACTGAAATATGTTTTGGTGGGGATGGGACGGT

GGACTTCCATTCTCCCTAAACTGGAGTTTTGGTCGGTAATCAAAACTAAAAGAAACC

TCTGGGAGACTGGAAACCTGATTGGAGCACTGAGGAACAAGGGAATGAAAAGGCA

GACTCTCTGAACGTTTGATGAAATGGACTCTTGTGAAAATTAACAGTGAATATTCAC

TGTTGCACTGTACGAAGTCTCTGAAATGTAATTAAAAGTTTTTATTGAGCCCCCGAG

CTTTGGC

TABLE 4

Oligonucleotide patterns (6 base pairs) over-represented in STAR elements.
The patterns are ranked according to significance coefficient. These were determined using RSA-Tools with the sequence of the human genome as reference. Patterns that comprise the most discriminant variables in Linear Discriminant Analysis are indicated with an asterisk (SEQ ID NOS: 218-383).

| Number | Oligonucleotide sequence | Observed occurrences | Expected occurrences | Significance coefficient | Number of matching STARs | SEQ ID NO: |
|---|---|---|---|---|---|---|
| 1 | CCCCAC | 107 | 49 | 8.76 | 51 | 218 |
| 2 | CAGCGG | 36 | 9 | 7.75 | 23 | 219 |
| 3 | GGCCCC | 74 | 31 | 7.21 | 34 | 220 |
| 4 | CAGCCC | 103 | 50 | 7.18 | 37 | 221 |
| 5 | GCCCCC | 70 | 29 | 6.97 | 34 | 222 |
| 6 | CGGGGC | 40 | 12 | 6.95 | 18 | 223 |
| 7 | CCCCGC | 43 | 13 | 6.79 | 22 | 224 |
| 8 | CGGCAG | 35 | 9 | 6.64 | 18 | 225 |

TABLE 4-continued

Oligonucleotide patterns (6 base pairs) over-represented in STAR elements. The patterns are ranked according to significance coefficient. These were determined using RSA-Tools with the sequence of the human genome as reference. Patterns that comprise the most discriminant variables in Linear Discriminant Analysis are indicated with an asterisk (SEQ ID NOS: 218-383).

| Number | Oligonucleotide sequence | Observed occurrences | Expected occurrences | Significance coefficient | Number of matching STARs | SEQ ID NO: |
|---|---|---|---|---|---|---|
| 9 | AGCCCC | 83 | 38 | 6.54 | 40 | 226 |
| 10 | CCAGGG | 107 | 54 | 6.52 | 43 | 227 |
| 11 | GGACCC* | 58 | 23 | 6.04 | 35 | 228 |
| 12 | GCGGAC | 20 | 3 | 5.94 | 14 | 229 |
| 13 | CCAGCG | 34 | 10 | 5.9 | 24 | 230 |
| 14 | GCAGCC | 92 | 45 | 5.84 | 43 | 231 |
| 15 | CCGGCA | 28 | 7 | 5.61 | 16 | 232 |
| 16 | AGCGGC | 27 | 7 | 5.45 | 17 | 233 |
| 17 | CAGGGG | 86 | 43 | 5.09 | 43 | 234 |
| 18 | CCGCCC | 43 | 15 | 5.02 | 18 | 235 |
| 19 | CCCCCG | 35 | 11 | 4.91 | 20 | 236 |
| 20 | GCCGCC | 34 | 10 | 4.88 | 18 | 237 |
| 21 | GCCGGC | 22 | 5 | 4.7 | 16 | 238 |
| 22 | CGGACC | 19 | 4 | 4.68 | 14 | 239 |
| 23 | CGCCCC | 35 | 11 | 4.64 | 19 | 240 |
| 24 | CGCCAG | 28 | 8 | 4.31 | 19 | 241 |
| 25 | CGCAGC | 29 | 8 | 4.29 | 20 | 242 |
| 26 | CAGCCG | 32 | 10 | 4 | 24 | 243 |
| 27 | CCCACG | 33 | 11 | 3.97 | 26 | 244 |
| 28 | GCTGCC | 78 | 40 | 3.9 | 43 | 245 |
| 29 | CCCTCC | 106 | 60 | 3.87 | 48 | 246 |
| 30 | CCCTGC* | 92 | 50 | 3.83 | 42 | 247 |
| 31 | CACCCC | 77 | 40 | 3.75 | 40 | 248 |
| 32 | GCGCCA | 30 | 10 | 3.58 | 23 | 249 |
| 33 | AGGGGC | 70 | 35 | 3.55 | 34 | 250 |
| 34 | GAGGGC | 66 | 32 | 3.5 | 40 | 251 |
| 35 | GCGAAC | 14 | 2 | 3.37 | 13 | 252 |
| 36 | CCGGCG | 17 | 4 | 3.33 | 12 | 253 |
| 37 | AGCCGG | 34 | 12 | 3.29 | 25 | 254 |
| 38 | GGAGCC | 67 | 34 | 3.27 | 40 | 255 |
| 39 | CCCCAG | 103 | 60 | 3.23 | 51 | 256 |
| 40 | CCGCTC | 24 | 7 | 3.19 | 19 | 257 |
| 41 | CCCCTC | 81 | 44 | 3.19 | 43 | 258 |
| 42 | CACCGC | 33 | 12 | 3.14 | 22 | 259 |
| 43 | CTGCCC | 96 | 55 | 3.01 | 42 | 260 |
| 44 | GGGCCA | 68 | 35 | 2.99 | 39 | 261 |
| 45 | CGCTGC | 28 | 9 | 2.88 | 22 | 262 |
| 46 | CAGCGC | 25 | 8 | 2.77 | 19 | 263 |
| 47 | CGGCCC | 28 | 10 | 2.73 | 19 | 264 |
| 48 | CCGCCG | 19 | 5 | 2.56 | 9 | 265 |
| 49 | CCCCGG | 30 | 11 | 2.41 | 17 | 266 |
| 50 | AGCCGC | 23 | 7 | 2.34 | 17 | 267 |
| 51 | GCACCC | 55 | 27 | 2.31 | 38 | 268 |
| 52 | AGGACC | 54 | 27 | 2.22 | 33 | 269 |
| 53 | AGGGCG | 24 | 8 | 2.2 | 18 | 270 |
| 54 | CAGGGC | 81 | 47 | 2.18 | 42 | 271 |
| 55 | CCCGCC | 45 | 21 | 2.15 | 20 | 272 |
| 56 | GCCAGC | 66 | 36 | 2.09 | 39 | 273 |
| 57 | AGCGCC | 21 | 6 | 2.09 | 18 | 274 |
| 58 | AGGCCC | 64 | 34 | 2.08 | 32 | 275 |
| 59 | CCCACC | 101 | 62 | 2.05 | 54 | 276 |
| 60 | CGCTCA | 21 | 6 | 2.03 | 17 | 277 |
| 61 | AACGCG | 9 | 1 | 1.96 | 9 | 278 |
| 62 | GCGGCA | 21 | 7 | 1.92 | 14 | 279 |
| 63 | AGGTCC | 49 | 24 | 1.87 | 36 | 280 |
| 64 | CCGTCA | 19 | 6 | 1.78 | 14 | 281 |
| 65 | CAGAGG | 107 | 68 | 1.77 | 47 | 282 |
| 66 | CCCGAG | 33 | 14 | 1.77 | 22 | 283 |
| 67 | CCGAGG | 36 | 16 | 1.76 | 25 | 284 |
| 68 | CGCGGA | 11 | 2 | 1.75 | 8 | 285 |
| 69 | CCACCC | 87 | 53 | 1.71 | 45 | 286 |
| 70 | CCTCGC | 23 | 8 | 1.71 | 20 | 287 |
| 71 | CAAGCC | 59 | 32 | 1.69 | 40 | 288 |
| 72 | TCCGCA | 18 | 5 | 1.68 | 17 | 289 |

TABLE 4-continued

Oligonucleotide patterns (6 base pairs) over-represented in STAR elements. The patterns are ranked according to significance coefficient. These were determined using RSA-Tools with the sequence of the human genome as reference. Patterns that comprise the most discriminant variables in Linear Discriminant Analysis are indicated with an asterisk (SEQ ID NOS: 218-383).

| Number | Oligonucleotide sequence | Observed occurrences | Expected occurrences | Significance coefficient | Number of matching STARs | SEQ ID NO: |
|---|---|---|---|---|---|---|
| 73 | CGCCGC | 18 | 5 | 1.67 | 9 | 290 |
| 74 | GGGAAC | 55 | 29 | 1.63 | 39 | 291 |
| 75 | CCAGAG | 93 | 58 | 1.57 | 49 | 292 |
| 76 | CGTTCC | 19 | 6 | 1.53 | 16 | 293 |
| 77 | CGAGGA | 23 | 8 | 1.5 | 19 | 294 |
| 78 | GGGACC | 48 | 24 | 1.48 | 31 | 295 |
| 79 | CCGCGA | 10 | 2 | 1.48 | 8 | 296 |
| 80 | CCTGCG | 24 | 9 | 1.45 | 17 | 297 |
| 81 | CTGCGC | 23 | 8 | 1.32 | 14 | 298 |
| 82 | GACCCC | 47 | 24 | 1.31 | 33 | 299 |
| 83 | GCTCCA | 66 | 38 | 1.25 | 39 | 300 |
| 84 | CGCCAC | 33 | 15 | 1.19 | 21 | 301 |
| 85 | GCGGGA | 23 | 9 | 1.17 | 18 | 302 |
| 86 | CTGCGA | 18 | 6 | 1.15 | 15 | 303 |
| 87 | CTGCTC | 80 | 49 | 1.14 | 50 | 304 |
| 88 | CAGACG | 23 | 9 | 1.13 | 19 | 305 |
| 89 | CGAGAG | 21 | 8 | 1.09 | 17 | 306 |
| 90 | CGGTGC | 18 | 6 | 1.06 | 16 | 307 |
| 91 | CTCCCC | 84 | 53 | 1.05 | 47 | 308 |
| 92 | GCGGCC | 22 | 8 | 1.04 | 14 | 309 |
| 93 | CGGCGC | 14 | 4 | 1.04 | 13 | 310 |
| 94 | AAGCCC* | 60 | 34 | 1.03 | 42 | 311 |
| 95 | CCGCAG | 24 | 9 | 1.03 | 17 | 312 |
| 96 | GCCCAC | 59 | 34 | 0.95 | 35 | 313 |
| 97 | CACCCA | 92 | 60 | 0.93 | 49 | 314 |
| 98 | GCGCCC | 27 | 11 | 0.93 | 18 | 315 |
| 99 | ACCGGC | 15 | 4 | 0.92 | 13 | 316 |
| 100 | CTCGCA | 16 | 5 | 0.89 | 14 | 317 |
| 101 | ACGCTC | 16 | 5 | 0.88 | 12 | 318 |
| 102 | CTGGAC | 58 | 33 | 0.88 | 32 | 319 |
| 103 | GCCCCA | 67 | 40 | 0.87 | 38 | 320 |
| 104 | ACCGTC | 15 | 4 | 0.86 | 11 | 321 |
| 105 | CCCTCG | 21 | 8 | 0.8 | 18 | 322 |
| 106 | AGCCCG | 22 | 8 | 0.79 | 14 | 323 |
| 107 | ACCCGA | 16 | 5 | 0.78 | 13 | 324 |
| 108 | AGCAGC | 79 | 50 | 0.75 | 41 | 325 |
| 109 | ACCGCG | 14 | 4 | 0.69 | 7 | 326 |
| 110 | CGAGGC | 29 | 13 | 0.69 | 24 | 327 |
| 111 | AGCTGC | 70 | 43 | 0.64 | 36 | 328 |
| 112 | GGGGAC | 49 | 27 | 0.64 | 34 | 329 |
| 113 | CCGCAA | 16 | 5 | 0.64 | 12 | 330 |
| 114 | CGTCGC | 8 | 1 | 0.62 | 6 | 331 |
| 115 | CGTGAC | 17 | 6 | 0.57 | 15 | 332 |
| 116 | CGCCCA | 33 | 16 | 0.56 | 22 | 333 |
| 117 | CTCTGC | 97 | 65 | 0.54 | 47 | 334 |
| 118 | AGCGGG | 21 | 8 | 0.52 | 17 | 335 |
| 119 | ACCGCT | 15 | 5 | 0.5 | 11 | 336 |
| 120 | CCCAGG | 133 | 95 | 0.49 | 58 | 337 |
| 121 | CCCTCA | 71 | 45 | 0.49 | 39 | 338 |
| 122 | CCCCCA* | 77 | 49 | 0.49 | 42 | 339 |
| 123 | GGCGAA | 16 | 5 | 0.48 | 14 | 340 |
| 124 | CGGCTC | 29 | 13 | 0.47 | 19 | 341 |
| 125 | CTCGCC | 20 | 8 | 0.46 | 17 | 342 |
| 126 | CGGAGA | 20 | 8 | 0.45 | 14 | 343 |
| 127 | TCCCCA | 95 | 64 | 0.43 | 52 | 344 |
| 128 | GACACC | 44 | 24 | 0.42 | 33 | 345 |
| 129 | CTCCGA | 17 | 6 | 0.42 | 13 | 346 |
| 130 | CTCGTC | 17 | 6 | 0.42 | 14 | 347 |
| 131 | CGACCA | 13 | 4 | 0.39 | 11 | 348 |
| 132 | ATGACG | 17 | 6 | 0.37 | 12 | 349 |
| 133 | CCATCG | 17 | 6 | 0.37 | 13 | 350 |
| 134 | AGGGGA | 78 | 51 | 0.36 | 44 | 351 |
| 135 | GCTGCA | 77 | 50 | 0.35 | 43 | 352 |

TABLE 4-continued

Oligonucleotide patterns (6 base pairs) over-represented in STAR elements.
The patterns are ranked according to significance coefficient. These were determined using RSA-Tools with the sequence of the human genome as reference. Patterns that comprise the most discriminant variables in Linear Discriminant Analysis are indicated with an asterisk (SEQ ID NOS: 218-383).

| Number | Oligonucleotide sequence | Observed occurrences | Expected occurrences | Significance coefficient | Number of matching STARs | SEQ ID NO: |
|---|---|---|---|---|---|---|
| 136 | ACCCCA | 76 | 49 | 0.33 | 40 | 353 |
| 137 | CGGAGC | 21 | 9 | 0.33 | 16 | 354 |
| 138 | CCTCCG | 28 | 13 | 0.32 | 19 | 355 |
| 139 | CGGGAC | 16 | 6 | 0.3 | 10 | 356 |
| 140 | CCTGGA | 88 | 59 | 0.3 | 45 | 357 |
| 141 | AGGCGA | 18 | 7 | 0.29 | 17 | 358 |
| 142 | ACCCCT | 54 | 32 | 0.28 | 36 | 359 |
| 143 | GCTCCC | 56 | 34 | 0.27 | 36 | 360 |
| 144 | CGTCAC | 16 | 6 | 0.27 | 15 | 361 |
| 145 | AGCGCA | 16 | 6 | 0.26 | 11 | 362 |
| 146 | GAAGCC | 62 | 38 | 0.25 | 39 | 363 |
| 147 | GAGGCC | 79 | 52 | 0.22 | 42 | 364 |
| 148 | ACCCTC | 54 | 32 | 0.22 | 33 | 365 |
| 149 | CCCGGC | 37 | 20 | 0.21 | 21 | 366 |
| 150 | CGAGAA | 20 | 8 | 0.2 | 17 | 367 |
| 151 | CCACCG | 29 | 14 | 0.18 | 20 | 368 |
| 152 | ACTTCG | 16 | 6 | 0.17 | 14 | 369 |
| 153 | GATGAC | 48 | 28 | 0.17 | 35 | 370 |
| 154 | ACGAGG | 23 | 10 | 0.16 | 18 | 371 |
| 155 | CCGGAG | 20 | 8 | 0.15 | 18 | 372 |
| 156 | ACCCAC | 60 | 37 | 0.12 | 41 | 373 |
| 157 | CTGGGC | 105 | 74 | 0.11 | 50 | 374 |
| 158 | CCACGG | 23 | 10 | 0.09 | 19 | 375 |
| 159 | CGGTCC | 13 | 4 | 0.09 | 12 | 376 |
| 160 | AGCACC* | 54 | 33 | 0.09 | 40 | 377 |
| 161 | ACACCC | 53 | 32 | 0.08 | 38 | 378 |
| 162 | AGGGCC | 54 | 33 | 0.08 | 30 | 379 |
| 163 | CGCGAA | 6 | 1 | 0.02 | 6 | 380 |
| 164 | GAGCCC | 58 | 36 | 0.02 | 36 | 381 |
| 165 | CTGAGC | 71 | 46 | 0.02 | 45 | 382 |
| 166 | AATCGG | 13 | 4 | 0.02 | 11 | 383 |

TABLE 5

Dyad patterns over-represented in STAR elements.
The patterns are ranked according to significance coefficient. These were determined using RSA-Tools with the random sequence from the human genome as reference. Patterns that comprise the most discriminant variables in Linear Discriminant Analysis are indicated with an asterisk (SEQ ID NOS: 384-1113).

| Number | Dyad sequence | Observed occurrences | Expected occurrences | Significance coefficient | SEQ ID NO: |
|---|---|---|---|---|---|
| 1 | CCCN{2}CGG | 36 | 7 | 9.31 | 384 |
| 2 | CCGN{6}CCC | 40 | 10 | 7.3 | 385 |
| 3 | CAGN{0}CGG | 36 | 8 | 7.13 | 386 |
| 4 | CGCN{15}CCC | 34 | 8 | 6.88 | 387 |
| 5 | CGGN{9}GCC | 33 | 7 | 6.82 | 388 |
| 6 | CCCN{9}CGC | 35 | 8 | 6.72 | 389 |
| 7 | CCCN{1}GCG | 34 | 8 | 6.64 | 390 |
| 8 | CCCN{0}CAC | 103 | 48 | 6.61 | 391 |
| 9 | AGCN{16}CCG | 29 | 6 | 5.96 | 392 |
| 10 | CCCN{4}CGC | 34 | 8 | 5.8 | 393 |
| 11 | CGCN{13}GGA | 26 | 5 | 5.77 | 394 |
| 12 | GCCN{16}CCC | 30 | 7 | 5.74 | 395 |
| 13 | CGCN{5}GCA | 25 | 5 | 5.49 | 396 |
| 14 | CCCN{14}CCC | 101 | 49 | 5.43 | 397 |
| 15 | CTGN{4}CGC | 34 | 9 | 5.41 | 398 |
| 16 | CCAN{12}GCG | 28 | 6 | 5.37 | 399 |
| 17 | CGGN{11}CAG | 36 | 10 | 5.25 | 400 |
| 18 | CCCN{5}GCC | 75 | 33 | 4.87 | 401 |
| 19 | GCCN{0}CCC | 64 | 26 | 4.81 | 402 |
| 20 | CGCN{4}GAC | 19 | 3 | 4.78 | 403 |
| 21 | CGGN{0}CAG | 33 | 9 | 4.76 | 404 |
| 22 | CCCN{3}CGC | 32 | 8 | 4.67 | 405 |
| 23 | CGCN{1}GAC | 20 | 3 | 4.58 | 406 |
| 24 | GCGN{2}GCC | 29 | 7 | 4.54 | 407 |
| 25 | CCCN{4}GCC | 76 | 34 | 4.53 | 408 |
| 26 | CCCN{1}CCC | 103 | 52 | 4.53 | 409 |
| 27 | CCGN{13}CAG | 33 | 9 | 4.5 | 410 |
| 28 | GCCN{4}GGA | 64 | 27 | 4.48 | 411 |
| 29 | CCGN{3}GGA | 26 | 6 | 4.46 | 412 |
| 30 | AGGN{2}GGG | 118 | 63 | 4.44 | 413 |
| 31 | CACN{5}GCG | 22 | 4 | 4.42 | 414 |
| 32 | CGCN{17}CCA | 27 | 6 | 4.39 | 415 |

TABLE 5-continued

Dyad patterns over-represented in STAR elements.
The patterns are ranked according to significance coefficient. These were determined using RSA-Tools with the random sequence from the human genome as reference.
Patterns that comprise the most discriminant variables in Linear Discriminant Analysis are indicated with an asterisk
(SEQ ID NOS: 384-1113).

| Number | Dyad sequence | Observed occurrences | Expected occurrences | Significance coefficient | SEQ ID NO: |
|---|---|---|---|---|---|
| 33 | CCCN{9}GGC | 69 | 30 | 4.38 | 416 |
| 34 | CCTN{5}GCG | 28 | 7 | 4.37 | 417 |
| 35 | GCGN{0}GAC | 19 | 3 | 4.32 | 418 |
| 36 | GCCN{0}GGC | 40 | 7 | 4.28 | 419 |
| 37 | GCGN{2}CCC | 26 | 6 | 4.27 | 420 |
| 38 | CCGN{11}CCC | 32 | 9 | 4.17 | 421 |
| 39 | CCCN{8}TCG | 23 | 5 | 4.12 | 422 |
| 40 | CCGN{17}GCC | 30 | 8 | 4.12 | 423 |
| 41 | GGGN{5}GGA | 101 | 52 | 4.11 | 424 |
| 42 | GGCN{6}GGA | 71 | 32 | 4.1 | 425 |
| 43 | CCAN{4}CCC | 96 | 48 | 4.1 | 426 |
| 44 | CCTN{14}CCG | 32 | 9 | 4.09 | 427 |
| 45 | GACN{12}GGC | 45 | 16 | 4.07 | 428 |
| 46 | CGCN{13}CCC | 30 | 8 | 4.04 | 429 |
| 47 | CAGN{16}CCC | 92 | 46 | 4.02 | 430 |
| 48 | AGCN{10}GGG | 75 | 35 | 3.94 | 431 |
| 49 | CGGN{13}GGC | 30 | 8 | 3.93 | 432 |
| 50 | CGGN{1}GCC | 30 | 8 | 3.92 | 433 |
| 51 | AGCN{0}GGC | 26 | 6 | 3.9 | 434 |
| 52 | CCCN{16}GGC | 64 | 28 | 3.89 | 435 |
| 53 | GCTN{19}CCC | 67 | 29 | 3.87 | 436 |
| 54 | CCCN{16}GGG | 88 | 31 | 3.81 | 437 |
| 55 | CCCN{9}CGG | 30 | 8 | 3.77 | 438 |
| 56 | CCCN{10}CGG | 30 | 8 | 3.76 | 439 |
| 57 | CCAN{0}GCG | 32 | 9 | 3.75 | 440 |
| 58 | GCCN{17}CGC | 26 | 6 | 3.74 | 441 |
| 59 | CCTN{6}CGC | 27 | 7 | 3.73 | 442 |
| 60 | GGAN{1}CCC | 63 | 27 | 3.71 | 443 |
| 61 | CGCN{18}CAC | 24 | 5 | 3.7 | 444 |
| 62 | CGCN{20}CCG | 21 | 4 | 3.69 | 445 |
| 63 | CCGN{0}GCA | 26 | 6 | 3.69 | 446 |
| 64 | CGCN{20}CCC | 28 | 7 | 3.69 | 447 |
| 65 | AGCN{15}CCC | 67 | 30 | 3.65 | 448 |
| 66 | CCTN{7}GGC | 69 | 31 | 3.63 | 449 |
| 67 | GCCN{5}CGC | 32 | 9 | 3.61 | 450 |
| 68 | GCCN{14}CGC | 28 | 7 | 3.59 | 451 |
| 69 | CAGN{11}CCC | 89 | 45 | 3.58 | 452 |
| 70 | GGGN{16}GAC | 53 | 21 | 3.57 | 453 |
| 71 | CCCN{15}GCG | 25 | 6 | 3.57 | 454 |
| 72 | CCCN{0}CGC | 37 | 12 | 3.54 | 455 |
| 73 | CCCN{16}AGC* | 67 | 30 | 3.54 | 456 |
| 74 | AGGN{9}GGG | 96 | 50 | 3.52 | 457 |
| 75 | CGCN{12}CTC | 28 | 7 | 3.46 | 458 |
| 76 | CACN{8}CGC | 23 | 5 | 3.43 | 459 |
| 77 | CCAN{7}CCG | 31 | 9 | 3.42 | 460 |
| 78 | CGGN{1}GCA | 25 | 6 | 3.41 | 461 |
| 79 | CGCN{14}CCC | 29 | 8 | 3.4 | 462 |
| 80 | AGCN{0}CCC | 76 | 36 | 3.4 | 463 |
| 81 | CGCN{13}GTC | 18 | 3 | 3.37 | 464 |
| 82 | GCGN{3}GCA | 26 | 7 | 3.35 | 465 |
| 83 | CGGN{0}GGC | 34 | 11 | 3.35 | 466 |
| 84 | GCCN{14}CCC | 68 | 31 | 3.33 | 467 |
| 85 | ACCN{7}CGC | 21 | 4 | 3.32 | 468 |
| 86 | AGGN{7}CGG | 33 | 10 | 3.31 | 469 |
| 87 | CCCN{16}CGA | 22 | 5 | 3.3 | 470 |
| 88 | CGCN{6}CAG | 31 | 9 | 3.29 | 471 |
| 89 | CAGN{11}GCG | 29 | 8 | 3.29 | 472 |
| 90 | CCGN{12}CCG | 19 | 4 | 3.26 | 473 |
| 91 | CGCN{18}CAG | 27 | 7 | 3.24 | 474 |
| 92 | CAGN{1}GGG | 80 | 39 | 3.21 | 475 |
| 93 | CGCN{0}CCC | 32 | 10 | 3.2 | 476 |
| 94 | GCGN{18}GCC | 26 | 7 | 3.18 | 477 |
| 95 | CGGN{15}GGC | 27 | 7 | 3.15 | 478 |
| 96 | CCCN{15}AGG | 72 | 34 | 3.14 | 479 |

TABLE 5-continued

Dyad patterns over-represented in STAR elements.
The patterns are ranked according to significance coefficient. These were determined using RSA-Tools with the random sequence from the human genome as reference.
Patterns that comprise the most discriminant variables in Linear Discriminant Analysis are indicated with an asterisk
(SEQ ID NOS: 384-1113).

| Number | Dyad sequence | Observed occurrences | Expected occurrences | Significance coefficient | SEQ ID NO: |
|---|---|---|---|---|---|
| 97 | AGGN{20}GCG | 26 | 7 | 3.14 | 480 |
| 98 | CGGN{5}CTC | 26 | 7 | 3.13 | 481 |
| 99 | TCCN{17}CGA | 23 | 5 | 3.12 | 482 |
| 100 | GCGN{4}CCC | 30 | 9 | 3.08 | 483 |
| 101 | CCCN{2}CGC | 30 | 9 | 3.07 | 484 |
| 102 | CGTN{3}CAG | 28 | 8 | 3.06 | 485 |
| 103 | CCGN{13}GAG | 27 | 7 | 3.05 | 486 |
| 104 | CTCN{6}CGC | 28 | 8 | 3.04 | 487 |
| 105 | CGCN{4}GAG | 21 | 5 | 3.03 | 488 |
| 106 | GCGN{5}GGA | 24 | 6 | 3.03 | 489 |
| 107 | CCGN{1}CAG | 27 | 7 | 3.01 | 490 |
| 108 | CGCN{11}CCG | 18 | 3 | 2.99 | 491 |
| 109 | GCGN{19}CCC | 26 | 7 | 2.98 | 492 |
| 110 | CGCN{18}GAA | 21 | 5 | 2.98 | 493 |
| 111 | GGGN{19}GGA | 78 | 39 | 2.95 | 494 |
| 112 | CCAN{1}CGG | 24 | 6 | 2.94 | 495 |
| 113 | CCCN{7}GCG | 25 | 6 | 2.94 | 496 |
| 114 | AGGN{10}CCC | 84 | 43 | 2.92 | 497 |
| 115 | CCAN{0}GGG | 97 | 52 | 2.88 | 498 |
| 116 | CAGN{10}CCC | 82 | 41 | 2.87 | 499 |
| 117 | CCGN{18}CCG | 19 | 4 | 2.86 | 500 |
| 118 | CCGN{18}GGC | 26 | 7 | 2.85 | 501 |
| 119 | CCCN{2}GCG | 24 | 6 | 2.84 | 502 |
| 120 | CGCN{1}GGC | 25 | 7 | 2.83 | 503 |
| 121 | CCGN{5}GAC | 19 | 4 | 2.81 | 504 |
| 122 | GGAN{0}CCC | 52 | 22 | 2.8 | 505 |
| 123 | CCCN{1}CCG | 29 | 9 | 2.78 | 506 |
| 124 | CCCN{15}ACG | 23 | 6 | 2.75 | 507 |
| 125 | AGCN{8}CCC | 66 | 31 | 2.73 | 508 |
| 126 | CCCN{3}GGC | 60 | 27 | 2.71 | 509 |
| 127 | AGGN{9}CGG | 31 | 10 | 2.7 | 510 |
| 128 | CCCN{14}CGC | 27 | 8 | 2.7 | 511 |
| 129 | CCGN{0}CCG | 19 | 4 | 2.7 | 512 |
| 130 | CGCN{8}AGC | 23 | 6 | 2.69 | 513 |
| 131 | CGCN{19}ACC | 21 | 5 | 2.68 | 514 |
| 132 | GCGN{17}GAC | 17 | 3 | 2.66 | 515 |
| 133 | AGCN{1}GCG | 24 | 6 | 2.63 | 516 |
| 134 | CCGN{11}GGC | 31 | 10 | 2.63 | 517 |
| 135 | CGGN{4}AGA | 26 | 7 | 2.63 | 518 |
| 136 | CGCN{14}CCG | 17 | 3 | 2.62 | 519 |
| 137 | CCTN{20}GCG | 24 | 6 | 2.62 | 520 |
| 138 | CCAN{10}CGC | 26 | 7 | 2.61 | 521 |
| 139 | CCCN{20}CAC | 69 | 33 | 2.6 | 522 |
| 140 | CCGN{11}GCC | 27 | 8 | 2.6 | 523 |
| 141 | CGCN{18}CCC | 26 | 7 | 2.59 | 524 |
| 142 | CGGN{15}CGC | 16 | 3 | 2.57 | 525 |
| 143 | CGCN{16}GCC | 24 | 6 | 2.55 | 526 |
| 144 | CGCN{20}GGC | 23 | 6 | 2.54 | 527 |
| 145 | CGCN{19}CCG | 18 | 4 | 2.52 | 528 |
| 146 | CGGN{10}CCA | 28 | 8 | 2.51 | 529 |
| 147 | CGCN{17}CCC | 26 | 7 | 2.51 | 530 |
| 148 | CGCN{11}ACA | 23 | 6 | 2.51 | 531 |
| 149 | CGGN{0}ACC | 17 | 3 | 2.5 | 532 |
| 150 | GCGN{10}GCC | 24 | 6 | 2.49 | 533 |
| 151 | GCGN{8}GAC | 17 | 3 | 2.49 | 534 |
| 152 | CCCN{15}GGG | 84 | 32 | 2.44 | 535 |
| 153 | CGGN{16}GGC | 27 | 8 | 2.44 | 536 |
| 154 | CGCN{16}CCA | 23 | 6 | 2.42 | 537 |
| 155 | GCCN{3}CCC | 73 | 36 | 2.4 | 538 |
| 156 | CAGN{4}GGG | 94 | 51 | 2.4 | 539 |
| 157 | CCCN{6}GCG | 23 | 6 | 2.38 | 540 |
| 158 | CCGN{16}CGC | 17 | 3 | 2.38 | 541 |
| 159 | CCCN{17}GCA | 61 | 28 | 2.37 | 542 |
| 160 | CGCN{13}TCC | 24 | 6 | 2.37 | 543 |

TABLE 5-continued

Dyad patterns over-represented in STAR elements.
The patterns are ranked according to significance coefficient. These were determined using RSA-Tools with the random sequence from the human genome as reference.
Patterns that comprise the most discriminant variables in Linear Discriminant Analysis are indicated with an asterisk
(SEQ ID NOS: 384-1113).

| Number | Dyad sequence | Observed occurrences | Expected occurrences | Significance coefficient | SEQ ID NO: |
|---|---|---|---|---|---|
| 161 | GCCN{1}CGC | 29 | 9 | 2.36 | 544 |
| 162 | CCGN{19}GAG | 26 | 7 | 2.35 | 545 |
| 163 | GGGN{10}GGA | 89 | 48 | 2.35 | 546 |
| 164 | CAGN{5}CCG | 32 | 11 | 2.35 | 547 |
| 165 | CGCN{3}AGA | 19 | 4 | 2.32 | 548 |
| 166 | GCCN{0}GCC | 29 | 9 | 2.32 | 549 |
| 167 | CCCN{8}GGC | 61 | 28 | 2.31 | 550 |
| 168 | CCTN{6}GCG | 22 | 6 | 2.29 | 551 |
| 169 | GACN{6}CCC | 48 | 20 | 2.29 | 552 |
| 170 | CGGN{1}CCC | 26 | 8 | 2.27 | 553 |
| 171 | CCCN{15}CCG | 30 | 10 | 2.27 | 554 |
| 172 | CAGN{9}CCC | 84 | 44 | 2.26 | 555 |
| 173 | CGGN{10}GGC | 27 | 8 | 2.26 | 556 |
| 174 | CGAN{10}ACG | 10 | 1 | 2.26 | 557 |
| 175 | GCGN{3}TCC | 21 | 5 | 2.26 | 558 |
| 176 | CCCN{3}GCC | 75 | 38 | 2.24 | 559 |
| 177 | GCGN{1}ACC | 17 | 3 | 2.24 | 560 |
| 178 | CCGN{9}AGG | 27 | 8 | 2.23 | 561 |
| 179 | CGCN{16}CAG | 26 | 8 | 2.23 | 562 |
| 180 | GGCN{0}CCC | 62 | 29 | 2.22 | 563 |
| 181 | AGGN{12}CCG | 26 | 8 | 2.19 | 564 |
| 182 | CCGN{0}GCG | 16 | 3 | 2.19 | 565 |
| 183 | CCGN{2}GCC | 30 | 10 | 2.18 | 566 |
| 184 | CCGN{11}GTC | 19 | 4 | 2.17 | 567 |
| 185 | CAGN{0}CCC | 88 | 47 | 2.17 | 568 |
| 186 | CCCN{5}CCG | 32 | 11 | 2.17 | 569 |
| 187 | GCCN{20}CCC | 66 | 32 | 2.15 | 570 |
| 188 | GACN{2}CGC | 18 | 4 | 2.14 | 571 |
| 189 | CGCN{6}CAC | 23 | 6 | 2.13 | 572 |
| 190 | AGGN{14}GCG | 25 | 7 | 2.1 | 573 |
| 191 | GACN{5}CGC | 17 | 3 | 2.1 | 574 |
| 192 | CCTN{19}CCG | 29 | 9 | 2.1 | 575 |
| 193 | CCGN{12}GGA | 24 | 7 | 2.08 | 576 |
| 194 | GGCN{9}GAC* | 44 | 18 | 2.08 | 577 |
| 195 | AGGN{10}GGG | 94 | 52 | 2.07 | 578 |
| 196 | CCGN{10}GAG | 25 | 7 | 2.07 | 579 |
| 197 | CGCN{6}GGA | 20 | 5 | 2.06 | 580 |
| 198 | CGCN{7}AGC | 23 | 6 | 2.04 | 581 |
| 199 | CCAN{13}CGG | 26 | 8 | 2.03 | 582 |
| 200 | CGGN{6}GGA | 25 | 7 | 2.03 | 583 |
| 201 | CGCN{19}GCC | 24 | 7 | 2.03 | 584 |
| 202 | CCAN{12}CGC | 24 | 7 | 2.02 | 585 |
| 203 | CGGN{1}GGC | 41 | 16 | 2.02 | 586 |
| 204 | GCGN{3}CCA | 25 | 7 | 2.01 | 587 |
| 205 | AGGN{1}CGC | 21 | 5 | 2 | 588 |
| 206 | CTCN{5}CGC | 24 | 7 | 1.98 | 589 |
| 207 | CCCN{0}ACG | 30 | 10 | 1.97 | 590 |
| 208 | CAGN{17}CCG | 29 | 9 | 1.96 | 591 |
| 209 | GGCN{4}CCC | 62 | 30 | 1.96 | 592 |
| 210 | AGGN{8}GCG | 26 | 8 | 1.96 | 593 |
| 211 | CTGN{1}CCC | 88 | 48 | 1.94 | 594 |
| 212 | CCCN{16}CAG | 85 | 46 | 1.94 | 595 |
| 213 | CGCN{9}GAC | 16 | 3 | 1.93 | 596 |
| 214 | CAGN{6}CCG | 29 | 9 | 1.92 | 597 |
| 215 | CGTN{12}CGC | 11 | 1 | 1.92 | 598 |
| 216 | CTCN{7}GCC | 69 | 35 | 1.92 | 599 |
| 217 | CGCN{19}TCC | 22 | 6 | 1.92 | 600 |
| 218 | CCCN{7}GCC | 67 | 33 | 1.91 | 601 |
| 219 | CAGN{13}CGG | 30 | 10 | 1.9 | 602 |
| 220 | CGCN{1}GCC | 27 | 8 | 1.9 | 603 |
| 221 | CGCN{17}CCG | 17 | 4 | 1.89 | 604 |
| 222 | AGGN{4}CCC | 63 | 31 | 1.89 | 605 |
| 223 | AGCN{10}CGC | 21 | 5 | 1.89 | 606 |
| 224 | CCCN{11}CGG | 30 | 10 | 1.88 | 607 |

TABLE 5-continued

Dyad patterns over-represented in STAR elements.
The patterns are ranked according to significance coefficient. These were determined using RSA-Tools with the random sequence from the human genome as reference.
Patterns that comprise the most discriminant variables in Linear Discriminant Analysis are indicated with an asterisk
(SEQ ID NOS: 384-1113).

| Number | Dyad sequence | Observed occurrences | Expected occurrences | Significance coefficient | SEQ ID NO: |
|---|---|---|---|---|---|
| 225 | CCCN{8}GCC | 75 | 39 | 1.86 | 608 |
| 226 | CCGN{1}CGG | 22 | 3 | 1.86 | 609 |
| 227 | CCCN{1}ACC | 71 | 36 | 1.85 | 610 |
| 228 | CGCN{0}CAG | 25 | 7 | 1.85 | 611 |
| 229 | CCGN{19}TGC | 23 | 6 | 1.82 | 612 |
| 230 | GCGN{4}CGA | 12 | 2 | 1.82 | 613 |
| 231 | CCGN{19}GCC | 30 | 10 | 1.82 | 614 |
| 232 | CCAN{10}CCC | 85 | 46 | 1.81 | 615 |
| 233 | CAGN{13}GGG | 91 | 51 | 1.81 | 616 |
| 234 | AGCN{18}CGG | 23 | 6 | 1.81 | 617 |
| 235 | CGAN{8}CGC | 11 | 1 | 1.81 | 618 |
| 236 | AGCN{4}CCC | 63 | 31 | 1.8 | 619 |
| 237 | GGAN{6}CCC | 61 | 30 | 1.8 | 620 |
| 238 | CGGN{13}AAG | 23 | 6 | 1.8 | 621 |
| 239 | ACCN{11}CGC | 19 | 5 | 1.79 | 622 |
| 240 | CCGN{12}CAG | 28 | 9 | 1.78 | 623 |
| 241 | CCCN{12}GGG | 76 | 29 | 1.77 | 624 |
| 242 | CACN{17}ACG | 22 | 6 | 1.76 | 625 |
| 243 | CAGN{18}CCC | 82 | 44 | 1.76 | 626 |
| 244 | CGTN{10}GTC | 19 | 5 | 1.75 | 627 |
| 245 | CCCN{13}GCG | 23 | 6 | 1.75 | 628 |
| 246 | GCAN{1}CGC | 20 | 5 | 1.73 | 629 |
| 247 | AGAN{4}CCG | 24 | 7 | 1.73 | 630 |
| 248 | GCGN{10}AGC | 22 | 6 | 1.72 | 631 |
| 249 | CGCN{0}GGA | 12 | 2 | 1.72 | 632 |
| 250 | CGGN{4}GAC | 17 | 4 | 1.69 | 633 |
| 251 | CCCN{12}CGC | 26 | 8 | 1.68 | 634 |
| 252 | GCCN{15}CCC | 65 | 33 | 1.68 | 635 |
| 253 | GCGN{6}TCC | 20 | 5 | 1.66 | 636 |
| 254 | CGGN{3}CAG | 33 | 12 | 1.65 | 637 |
| 255 | CCCN{3}CCA | 88 | 49 | 1.65 | 638 |
| 256 | AGCN{3}CCC | 59 | 28 | 1.65 | 639 |
| 257 | GGGN{16}GCA | 65 | 33 | 1.65 | 640 |
| 258 | AGGN{8}CCG | 28 | 9 | 1.64 | 641 |
| 259 | CCCN{0}CCG | 29 | 10 | 1.64 | 642 |
| 260 | GCGN{5}GAC | 16 | 3 | 1.64 | 643 |
| 261 | CCCN{9}ACC | 60 | 29 | 1.64 | 644 |
| 262 | CTGN{5}CGC | 25 | 8 | 1.64 | 645 |
| 263 | CGCN{14}CTC | 23 | 7 | 1.64 | 646 |
| 264 | CGGN{14}GCA | 23 | 7 | 1.63 | 647 |
| 265 | CCGN{8}GCC | 26 | 8 | 1.62 | 648 |
| 266 | CCGN{7}CAC | 23 | 7 | 1.62 | 649 |
| 267 | AGCN{8}GCG | 21 | 6 | 1.61 | 650 |
| 268 | CGGN{16}GGA | 29 | 10 | 1.61 | 651 |
| 269 | CCAN{12}CCG | 26 | 8 | 1.61 | 652 |
| 270 | CGGN{2}CCC | 26 | 8 | 1.6 | 653 |
| 271 | CCAN{13}GGG | 71 | 37 | 1.6 | 654 |
| 272 | CGGN{15}GCA | 21 | 6 | 1.6 | 655 |
| 273 | CGCN{9}GCA | 20 | 5 | 1.58 | 656 |
| 274 | CGGN{19}CCA | 26 | 8 | 1.58 | 657 |
| 275 | GGGN{15}CGA | 20 | 5 | 1.57 | 658 |
| 276 | CCCN{10}CGC | 26 | 8 | 1.57 | 659 |
| 277 | CTCN{14}CGC | 26 | 8 | 1.55 | 660 |
| 278 | CACN{11}GCG | 20 | 5 | 1.55 | 661 |
| 279 | CCGN{2}GGC | 24 | 7 | 1.55 | 662 |
| 280 | CTGN{18}CCC | 85 | 47 | 1.54 | 663 |
| 281 | GGGN{13}CAC | 58 | 28 | 1.54 | 664 |
| 282 | CCTN{15}GGC | 62 | 31 | 1.54 | 665 |
| 283 | CCCN{20}CGA | 20 | 5 | 1.54 | 666 |
| 284 | CCCN{8}CGA | 20 | 5 | 1.53 | 667 |
| 285 | GAGN{7}CCC | 61 | 30 | 1.53 | 668 |
| 286 | CGCN{2}CCG | 22 | 6 | 1.53 | 669 |
| 287 | CCCN{0}TCC | 98 | 57 | 1.52 | 670 |
| 288 | AGCN{0}GCC | 21 | 6 | 1.52 | 671 |

TABLE 5-continued

Dyad patterns over-represented in STAR elements.
The patterns are ranked according to significance coefficient. These were determined using RSA-Tools with the random sequence from the human genome as reference.
Patterns that comprise the most discriminant variables in Linear Discriminant Analysis are indicated with an asterisk
(SEQ ID NOS: 384-1113).

| Number | Dyad sequence | Observed occurrences | Expected occurrences | Significance coefficient | SEQ ID NO: |
|---|---|---|---|---|---|
| 289 | CCCN{2}TCC | 82 | 45 | 1.52 | 672 |
| 290 | CCGN{5}CCC | 30 | 10 | 1.52 | 673 |
| 291 | CGCN{13}CGC | 16 | 3 | 1.51 | 674 |
| 292 | CCCN{1}CGC | 28 | 9 | 1.51 | 675 |
| 293 | GCCN{16}GCA | 53 | 25 | 1.51 | 676 |
| 294 | CCCN{16}CCA | 84 | 46 | 1.5 | 677 |
| 295 | CCGN{13}CGC | 19 | 5 | 1.5 | 678 |
| 296 | CCGN{17}CAG | 28 | 9 | 1.49 | 679 |
| 297 | CGGN{18}GGC | 26 | 8 | 1.49 | 680 |
| 298 | CCGN{14}AGG | 23 | 7 | 1.49 | 681 |
| 299 | CCCN{5}CGG | 26 | 8 | 1.49 | 682 |
| 300 | CCCN{6}GGA | 58 | 28 | 1.49 | 683 |
| 301 | ACGN{2}CCC | 20 | 5 | 1.49 | 684 |
| 302 | CCAN{9}CCG | 27 | 9 | 1.48 | 685 |
| 303 | CCCN{19}CCA | 78 | 42 | 1.48 | 686 |
| 304 | CAGN{0}GGG | 77 | 41 | 1.48 | 687 |
| 305 | AGCN{1}CCC | 58 | 28 | 1.47 | 688 |
| 306 | GCGN{7}TCC | 27 | 9 | 1.46 | 689 |
| 307 | ACGN{18}CCA | 25 | 8 | 1.46 | 690 |
| 308 | GCTN{14}CCC | 61 | 30 | 1.46 | 691 |
| 309 | GCGN{14}CCC | 23 | 7 | 1.46 | 692 |
| 310 | GCGN{19}AGC | 20 | 5 | 1.45 | 693 |
| 311 | CCGN{8}CAG | 29 | 10 | 1.45 | 694 |
| 312 | GCGN{6}GCC | 22 | 6 | 1.45 | 695 |
| 313 | GCGN{10}GCA | 20 | 5 | 1.44 | 696 |
| 314 | CCTN{7}GCC | 69 | 36 | 1.44 | 697 |
| 315 | GCCN{13}GCC | 54 | 26 | 1.42 | 698 |
| 316 | CCCN{14}GCC | 63 | 32 | 1.42 | 699 |
| 317 | CCCN{15}CGG | 26 | 8 | 1.42 | 700 |
| 318 | CCAN{13}CGC | 23 | 7 | 1.42 | 701 |
| 319 | AGCN{11}GGG | 67 | 35 | 1.41 | 702 |
| 320 | GGAN{0}GCC | 64 | 32 | 1.4 | 703 |
| 321 | GCCN{3}TCC | 61 | 30 | 1.4 | 704 |
| 322 | CCTN{5}GCC | 69 | 36 | 1.39 | 705 |
| 323 | CGGN{18}CCC | 25 | 8 | 1.39 | 706 |
| 324 | CCTN{3}GGC | 59 | 29 | 1.38 | 707 |
| 325 | CCGN{0}CTC | 22 | 6 | 1.38 | 708 |
| 326 | AGCN{17}GCG | 19 | 5 | 1.37 | 709 |
| 327 | ACGN{14}GGG | 20 | 5 | 1.37 | 710 |
| 328 | CGAN{12}GGC | 19 | 5 | 1.37 | 711 |
| 329 | CCCN{20}CGC | 24 | 7 | 1.37 | 712 |
| 330 | ACGN{12}CTG | 24 | 7 | 1.36 | 713 |
| 331 | CCGN{0}CCC | 36 | 14 | 1.36 | 714 |
| 332 | CCGN{10}GGA | 23 | 7 | 1.36 | 715 |
| 333 | CCCN{3}GCG | 21 | 6 | 1.36 | 716 |
| 334 | GCGN{14}CGC | 22 | 3 | 1.35 | 717 |
| 335 | CCGN{8}CGC | 16 | 4 | 1.35 | 718 |
| 336 | CGCN{10}ACA | 22 | 6 | 1.34 | 719 |
| 337 | CCCN{19}CCG | 28 | 10 | 1.33 | 720 |
| 338 | CACN{14}CGC | 20 | 5 | 1.32 | 721 |
| 339 | GACN{3}GGC | 46 | 21 | 1.32 | 722 |
| 340 | GAAN{7}CGC | 19 | 5 | 1.32 | 723 |
| 341 | CGCN{16}GGC | 21 | 6 | 1.31 | 724 |
| 342 | GGCN{9}CCC | 64 | 33 | 1.31 | 725 |
| 343 | CCCN{9}GCC | 64 | 33 | 1.31 | 726 |
| 344 | CGCN{0}TGC | 26 | 9 | 1.3 | 727 |
| 345 | CCTN{8}GGC | 67 | 35 | 1.3 | 728 |
| 346 | CCAN{8}CCC | 82 | 46 | 1.29 | 729 |
| 347 | GACN{2}CCC | 42 | 18 | 1.28 | 730 |
| 348 | GGCN{1}CCC | 54 | 26 | 1.27 | 731 |
| 349 | CGCN{0}AGC | 24 | 7 | 1.26 | 732 |
| 350 | AGGN{4}GCG | 28 | 10 | 1.26 | 733 |
| 351 | CGGN{6}TCC | 22 | 6 | 1.25 | 734 |
| 352 | ACGN{19}GGC | 20 | 5 | 1.25 | 735 |

TABLE 5-continued

Dyad patterns over-represented in STAR elements.
The patterns are ranked according to significance coefficient. These were determined using RSA-Tools with the random sequence from the human genome as reference.
Patterns that comprise the most discriminant variables in Linear Discriminant Analysis are indicated with an asterisk
(SEQ ID NOS: 384-1113).

| Number | Dyad sequence | Observed occurrences | Expected occurrences | Significance coefficient | SEQ ID NO: |
|---|---|---|---|---|---|
| 353 | CCCN{8}ACG | 21 | 6 | 1.24 | 736 |
| 354 | CCCN{18}GCC | 62 | 31 | 1.24 | 737 |
| 355 | GCCN{2}CGA | 19 | 5 | 1.24 | 738 |
| 356 | CCCN{8}GCG | 28 | 10 | 1.23 | 739 |
| 357 | CCCN{0}CTC | 76 | 41 | 1.23 | 740 |
| 358 | GCCN{11}CGC | 27 | 9 | 1.22 | 741 |
| 359 | AGCN{9}CCC | 59 | 29 | 1.22 | 742 |
| 360 | GCTN{0}GCC | 71 | 38 | 1.21 | 743 |
| 361 | CGCN{3}CCC | 26 | 9 | 1.21 | 744 |
| 362 | CCCN{2}CCC | 117 | 72 | 1.19 | 745 |
| 363 | GCCN{9}CGC | 23 | 7 | 1.19 | 746 |
| 364 | GCAN{19}CGC | 19 | 5 | 1.19 | 747 |
| 365 | CAGN{4}CGG | 32 | 12 | 1.18 | 748 |
| 366 | CAGN{2}GGG | 80 | 44 | 1.17 | 749 |
| 367 | GCCN{16}CCC | 67 | 35 | 1.16 | 750 |
| 368 | GAGN{5}CCC | 60 | 30 | 1.16 | 751 |
| 369 | CCTN{16}TCG | 20 | 6 | 1.16 | 752 |
| 370 | CCCN{2}GGC | 62 | 32 | 1.15 | 753 |
| 371 | GCGN{13}GGA | 24 | 8 | 1.15 | 754 |
| 372 | GCCN{17}GGC | 66 | 25 | 1.15 | 755 |
| 373 | CCCN{14}GGC | 58 | 29 | 1.14 | 756 |
| 374 | AGGN{3}CCG | 31 | 12 | 1.14 | 757 |
| 375 | CACN{0}CGC | 32 | 12 | 1.14 | 758 |
| 376 | CGGN{18}CAG | 28 | 10 | 1.14 | 759 |
| 377 | AGCN{1}GCC | 57 | 28 | 1.13 | 760 |
| 378 | CGCN{18}GGC | 23 | 7 | 1.13 | 761 |
| 379 | CCCN{5}AGG | 64 | 33 | 1.11 | 762 |
| 380 | AACN{0}GCG | 9 | 1 | 1.11 | 763 |
| 381 | CCCN{10}CCA | 88 | 50 | 1.09 | 764 |
| 382 | CGCN{13}GAG | 20 | 6 | 1.09 | 765 |
| 383 | CGCN{7}GCC | 25 | 8 | 1.08 | 766 |
| 384 | CCCN{9}CCG | 28 | 10 | 1.07 | 767 |
| 385 | CGCN{16}CCC | 24 | 8 | 1.05 | 768 |
| 386 | GAAN{13}CGC | 18 | 5 | 1.05 | 769 |
| 387 | GGCN{3}CCC | 49 | 23 | 1.03 | 770 |
| 388 | TCCN{11}CCA | 87 | 50 | 1.03 | 771 |
| 389 | CACN{0}CCC | 70 | 38 | 1.02 | 772 |
| 390 | CGCN{16}CCG | 15 | 3 | 1.02 | 773 |
| 391 | CGGN{15}AGC | 21 | 6 | 1.02 | 774 |
| 392 | CCCN{12}GCG | 21 | 6 | 1.02 | 775 |
| 393 | CCCN{9}GAG | 59 | 30 | 1.01 | 776 |
| 394 | CCGN{20}TCC | 24 | 8 | 1.01 | 777 |
| 395 | CGCN{0}CGC | 17 | 4 | 1.01 | 778 |
| 396 | ATGN{7}CGG | 20 | 6 | 1 | 779 |
| 397 | GGGN{20}GCA | 59 | 30 | 1 | 780 |
| 398 | CGGN{4}GGC | 26 | 9 | 0.99 | 781 |
| 399 | CGGN{16}AGC | 22 | 7 | 0.99 | 782 |
| 400 | CGGN{5}GGC | 25 | 8 | 0.99 | 783 |
| 401 | GCGN{0}GGA | 25 | 8 | 0.98 | 784 |
| 402 | GGCN{20}CAC | 52 | 25 | 0.98 | 785 |
| 403 | CCCN{9}CCC | 97 | 58 | 0.97 | 786 |
| 404 | ACCN{17}GGC | 44 | 20 | 0.97 | 787 |
| 405 | CCCN{6}CGA | 18 | 5 | 0.96 | 788 |
| 406 | AAGN{10}CGG | 26 | 9 | 0.96 | 789 |
| 407 | CGCN{17}CAC | 21 | 6 | 0.95 | 790 |
| 408 | CCCN{16}CGG | 25 | 8 | 0.94 | 791 |
| 409 | GACN{18}GGC | 39 | 17 | 0.94 | 792 |
| 410 | GGGN{15}GAC | 47 | 22 | 0.92 | 793 |
| 411 | GCCN{4}TCC | 66 | 35 | 0.92 | 794 |
| 412 | GGCN{15}CCC | 56 | 28 | 0.92 | 795 |
| 413 | CAGN{12}CGC | 24 | 8 | 0.92 | 796 |
| 414 | CCAN{3}GCG | 22 | 7 | 0.91 | 797 |
| 415 | CCGN{16}GAG | 22 | 7 | 0.9 | 798 |
| 416 | AGCN{2}CGC | 24 | 8 | 0.89 | 799 |

TABLE 5-continued

Dyad patterns over-represented in STAR elements.
The patterns are ranked according to significance coefficient. These were determined using RSA-Tools with the random sequence from the human genome as reference.
Patterns that comprise the most discriminant variables in Linear Discriminant Analysis are indicated with an asterisk
(SEQ ID NOS: 384-1113).

| Dyad Number | Dyad sequence | Observed occurrences | Expected occurrences | Significance coefficient | SEQ ID NO: |
|---|---|---|---|---|---|
| 417 | GAGN{4}CCC | 54 | 27 | 0.89 | 800 |
| 418 | AGGN{3}CGC | 23 | 7 | 0.88 | 801 |
| 419 | CACN{13}AGG* | 67 | 36 | 0.88 | 802 |
| 420 | CCCN{4}CAG | 88 | 51 | 0.88 | 803 |
| 421 | CCCN{2}GAA | 63 | 33 | 0.87 | 804 |
| 422 | CGCN{19}GAG | 21 | 6 | 0.87 | 805 |
| 423 | ACGN{18}GGG | 21 | 6 | 0.87 | 806 |
| 424 | CCCN{4}GGC | 62 | 32 | 0.87 | 807 |
| 425 | CGGN{9}GAG | 28 | 10 | 0.86 | 808 |
| 426 | CCCN{3}GGG | 66 | 26 | 0.86 | 809 |
| 427 | GAGN{4}GGC | 66 | 35 | 0.85 | 810 |
| 428 | CGCN{5}GAG | 18 | 5 | 0.84 | 811 |
| 429 | CCGN{20}AGG | 24 | 8 | 0.84 | 812 |
| 430 | CCCN{15}CCC | 88 | 51 | 0.83 | 813 |
| 431 | AGGN{17}CCG | 25 | 8 | 0.82 | 814 |
| 432 | AGGN{6}GGG | 89 | 52 | 0.82 | 815 |
| 433 | GGCN{20}CCC | 57 | 29 | 0.82 | 816 |
| 434 | GCAN{17}CGC | 19 | 5 | 0.82 | 817 |
| 435 | CGAN{11}ACG | 9 | 1 | 0.81 | 818 |
| 436 | CGCN{2}GGA | 19 | 5 | 0.81 | 819 |
| 437 | CTGN{5}CCC | 79 | 45 | 0.8 | 820 |
| 438 | TCCN{20}CCA | 77 | 43 | 0.8 | 821 |
| 439 | CCAN{2}GGG | 59 | 30 | 0.8 | 822 |
| 440 | CCGN{15}GCG | 14 | 3 | 0.8 | 823 |
| 441 | CCAN{5}GGG | 69 | 38 | 0.79 | 824 |
| 442 | CGGN{1}TGC | 24 | 8 | 0.79 | 825 |
| 443 | CCCN{14}GCG | 21 | 6 | 0.79 | 826 |
| 444 | CAGN{0}CCG | 27 | 10 | 0.79 | 827 |
| 445 | GCCN{9}TCC | 60 | 31 | 0.78 | 828 |
| 446 | AGGN{20}CGC | 22 | 7 | 0.78 | 829 |
| 447 | CCCN{6}GAC | 42 | 19 | 0.77 | 830 |
| 448 | CGGN{11}CCA | 23 | 7 | 0.76 | 831 |
| 449 | GGGN{14}CAC | 57 | 29 | 0.75 | 832 |
| 450 | GCAN{15}CGC | 19 | 5 | 0.74 | 833 |
| 451 | CGCN{2}ACA | 20 | 6 | 0.74 | 834 |
| 452 | ACCN{9}CCC | 57 | 29 | 0.73 | 835 |
| 453 | GCGN{9}CGC | 20 | 3 | 0.73 | 836 |
| 454 | CAGN{15}GCG | 23 | 7 | 0.73 | 837 |
| 455 | CCCN{18}GTC | 45 | 21 | 0.72 | 838 |
| 456 | GCGN{3}CCC | 24 | 8 | 0.72 | 839 |
| 457 | CGGN{11}GCC | 23 | 8 | 0.72 | 840 |
| 458 | CCCN{1}CGG | 24 | 8 | 0.71 | 841 |
| 459 | GCCN{4}CCA | 70 | 38 | 0.71 | 842 |
| 460 | CCCN{4}CCG | 30 | 12 | 0.7 | 843 |
| 461 | CGTN{2}GCA | 21 | 6 | 0.7 | 844 |
| 462 | AGCN{7}TCG | 18 | 5 | 0.69 | 845 |
| 463 | CCGN{15}GAA | 20 | 6 | 0.69 | 846 |
| 464 | ACCN{5}CCC | 62 | 33 | 0.69 | 847 |
| 465 | CGCN{14}GAG | 19 | 5 | 0.68 | 848 |
| 466 | CCCN{7}CGC | 30 | 12 | 0.68 | 849 |
| 467 | GAGN{12}CGC | 21 | 6 | 0.68 | 850 |
| 468 | GGCN{17}CCC | 58 | 30 | 0.67 | 851 |
| 469 | ACGN{11}CTC | 21 | 7 | 0.65 | 852 |
| 470 | ACAN{9}CGG | 24 | 8 | 0.65 | 853 |
| 471 | CTGN{7}CCC | 82 | 47 | 0.65 | 854 |
| 472 | CCCN{2}GCC | 72 | 40 | 0.65 | 855 |
| 473 | CGGN{2}GCA | 24 | 8 | 0.64 | 856 |
| 474 | CCCN{0}TGC | 83 | 48 | 0.64 | 857 |
| 475 | CGCN{7}ACC | 18 | 5 | 0.63 | 858 |
| 476 | GCAN{2}GCC | 54 | 27 | 0.63 | 859 |
| 477 | GCGN{8}CCA | 20 | 6 | 0.63 | 860 |
| 478 | AGCN{0}CGC | 22 | 7 | 0.63 | 861 |
| 479 | GCGN{2}GCA | 18 | 5 | 0.63 | 862 |
| 480 | CCGN{2}GTC | 18 | 5 | 0.62 | 863 |

TABLE 5-continued

Dyad patterns over-represented in STAR elements.
The patterns are ranked according to significance coefficient. These were determined using RSA-Tools with the random sequence from the human genome as reference.
Patterns that comprise the most discriminant variables in Linear Discriminant Analysis are indicated with an asterisk
(SEQ ID NOS: 384-1113).

| Number | Dyad sequence | Observed occurrences | Expected occurrences | Significance coefficient | SEQ ID NO: |
|---|---|---|---|---|---|
| 481 | CCGN{3}ACA | 21 | 7 | 0.62 | 864 |
| 482 | ACGN{13}TGG | 21 | 7 | 0.62 | 865 |
| 483 | CCAN{8}CGC | 23 | 8 | 0.62 | 866 |
| 484 | CCGN{9}GGC | 23 | 8 | 0.61 | 867 |
| 485 | CCAN{5}CCG | 25 | 9 | 0.61 | 868 |
| 486 | AGGN{3}GGG | 97 | 59 | 0.61 | 869 |
| 487 | CAGN{2}GGC | 78 | 45 | 0.61 | 870 |
| 488 | CCCN{8}CAG | 81 | 47 | 0.61 | 871 |
| 489 | AGCN{5}CAG | 80 | 46 | 0.6 | 872 |
| 490 | CGGN{16}GCC | 22 | 7 | 0.6 | 873 |
| 491 | GCGN{15}CCC | 23 | 8 | 0.6 | 874 |
| 492 | CCCN{11}GCC | 59 | 31 | 0.59 | 875 |
| 493 | CGAN{2}ACG | 9 | 1 | 0.59 | 876 |
| 494 | CGGN{4}GCC | 22 | 7 | 0.59 | 877 |
| 495 | CACN{6}CGC | 19 | 6 | 0.59 | 878 |
| 496 | CGGN{5}ACG | 11 | 2 | 0.59 | 879 |
| 497 | CTGN{4}GCC* | 66 | 36 | 0.59 | 880 |
| 498 | GGGN{18}CGA | 18 | 5 | 0.59 | 881 |
| 499 | CCTN{8}CGC | 22 | 7 | 0.59 | 882 |
| 500 | GCCN{4}CCC | 67 | 37 | 0.58 | 883 |
| 501 | CGGN{10}GCC | 22 | 7 | 0.58 | 884 |
| 502 | GCCN{5}GGA | 54 | 27 | 0.57 | 885 |
| 503 | ACCN{7}GCG | 15 | 4 | 0.57 | 886 |
| 504 | CCCN{8}CGC | 24 | 8 | 0.57 | 887 |
| 505 | CAGN{5}CCC | 77 | 44 | 0.56 | 888 |
| 506 | CACN{14}GGA | 63 | 34 | 0.56 | 889 |
| 507 | CCCN{1}GCC | 94 | 57 | 0.55 | 890 |
| 508 | CCCN{5}AGC | 67 | 37 | 0.55 | 891 |
| 509 | GGCN{5}GGA | 59 | 31 | 0.55 | 892 |
| 510 | CGAN{17}GAG | 19 | 6 | 0.55 | 893 |
| 511 | CGCN{7}ACA | 18 | 5 | 0.54 | 894 |
| 512 | CCAN{13}CCC | 87 | 52 | 0.54 | 895 |
| 513 | CGGN{20}GGC | 24 | 8 | 0.54 | 896 |
| 514 | CCCN{17}GCC | 58 | 30 | 0.53 | 897 |
| 515 | CCTN{10}CCG | 30 | 12 | 0.53 | 898 |
| 516 | CCCN{8}CCG | 27 | 10 | 0.53 | 899 |
| 517 | CGCN{3}GAG | 18 | 5 | 0.52 | 900 |
| 518 | CGCN{7}AAG | 17 | 5 | 0.51 | 901 |
| 519 | CGGN{11}GGA | 23 | 8 | 0.51 | 902 |
| 520 | CCGN{15}CCG | 15 | 4 | 0.51 | 903 |
| 521 | CCCN{3}GCA | 57 | 30 | 0.51 | 904 |
| 522 | CGGN{2}CAG | 24 | 8 | 0.5 | 905 |
| 523 | AGGN{2}CCG | 24 | 8 | 0.5 | 906 |
| 524 | CCCN{4}CAC | 69 | 38 | 0.5 | 907 |
| 525 | GGAN{19}CCC | 56 | 29 | 0.49 | 908 |
| 526 | CCCN{8}CAC | 68 | 38 | 0.49 | 909 |
| 527 | ACCN{6}CCG | 18 | 5 | 0.49 | 910 |
| 528 | CCCN{6}GGC | 54 | 28 | 0.49 | 911 |
| 529 | CCCN{6}CCG | 29 | 11 | 0.48 | 912 |
| 530 | CGCN{14}GCC | 26 | 9 | 0.47 | 913 |
| 531 | CCGN{5}TCC | 25 | 9 | 0.46 | 914 |
| 532 | GCCN{6}GCC | 55 | 28 | 0.46 | 915 |
| 533 | CGGN{7}GGA | 24 | 8 | 0.45 | 916 |
| 534 | GGGN{6}GGA | 87 | 52 | 0.44 | 917 |
| 535 | GCCN{12}TCC | 60 | 32 | 0.44 | 918 |
| 536 | AGTN{16}CCG | 17 | 5 | 0.44 | 919 |
| 537 | GGCN{19}GCC | 68 | 29 | 0.44 | 920 |
| 538 | CCGN{3}CCG | 22 | 7 | 0.44 | 921 |
| 539 | CCCN{8}ACC | 58 | 31 | 0.44 | 922 |
| 540 | CAGN{15}GCC | 77 | 44 | 0.44 | 923 |
| 541 | CCCN{17}CGG | 24 | 8 | 0.44 | 924 |
| 542 | GCGN{1}CCA | 22 | 7 | 0.44 | 925 |
| 543 | CCCN{14}CAG | 79 | 46 | 0.44 | 926 |
| 544 | CCCN{8}CCC | 89 | 53 | 0.44 | 927 |

TABLE 5-continued

Dyad patterns over-represented in STAR elements.
The patterns are ranked according to significance coefficient. These were determined using RSA-Tools with the random sequence from the human genome as reference.
Patterns that comprise the most discriminant variables in Linear Discriminant Analysis are indicated with an asterisk
(SEQ ID NOS: 384-1113).

| Number | Dyad sequence | Observed occurrences | Expected occurrences | Significance coefficient | SEQ ID NO: |
|---|---|---|---|---|---|
| 545 | ACAN{12}GCG | 23 | 8 | 0.43 | 928 |
| 546 | AGGN{4}CCG | 23 | 8 | 0.43 | 929 |
| 547 | CGCN{13}GCC | 23 | 8 | 0.43 | 930 |
| 548 | GAGN{2}CGC | 23 | 8 | 0.42 | 931 |
| 549 | CCCN{9}GCG | 21 | 7 | 0.42 | 932 |
| 550 | CGCN{17}ACA | 17 | 5 | 0.42 | 933 |
| 551 | GCGN{17}CCA | 23 | 8 | 0.42 | 934 |
| 552 | AAGN{18}CCG | 20 | 6 | 0.42 | 935 |
| 553 | CGCN{1}GGA | 18 | 5 | 0.41 | 936 |
| 554 | CCAN{1}CCC | 90 | 54 | 0.41 | 937 |
| 555 | CGTN{18}TGC | 20 | 6 | 0.41 | 938 |
| 556 | TCCN{14}CGA | 17 | 5 | 0.41 | 939 |
| 557 | CACN{5}GGG | 56 | 29 | 0.4 | 940 |
| 558 | CCGN{12}GCA | 21 | 7 | 0.4 | 941 |
| 559 | CTGN{6}CCC | 77 | 44 | 0.4 | 942 |
| 560 | CGGN{8}GGC | 32 | 13 | 0.4 | 943 |
| 561 | CCAN{11}GGG | 68 | 38 | 0.4 | 944 |
| 562 | ACGN{19}CAA | 21 | 7 | 0.39 | 945 |
| 563 | GGGN{20}CCC | 72 | 31 | 0.39 | 946 |
| 564 | CGCN{3}CAG | 23 | 8 | 0.39 | 947 |
| 565 | AGCN{17}GGG | 58 | 31 | 0.37 | 948 |
| 566 | CACN{20}CCG | 21 | 7 | 0.37 | 949 |
| 567 | ACGN{17}CAG | 24 | 8 | 0.37 | 950 |
| 568 | AGGN{1}CCC | 60 | 32 | 0.37 | 951 |
| 569 | CGTN{12}CAC | 20 | 6 | 0.37 | 952 |
| 570 | CGGN{9}GGC | 23 | 8 | 0.37 | 953 |
| 571 | CGCN{10}GCG | 18 | 3 | 0.37 | 954 |
| 572 | CCCN{6}CTC | 80 | 47 | 0.36 | 955 |
| 573 | CCGN{10}AGG | 23 | 8 | 0.36 | 956 |
| 574 | CCCN{18}CAG | 79 | 46 | 0.36 | 957 |
| 575 | AGCN{17}CCG | 21 | 7 | 0.36 | 958 |
| 576 | AGCN{9}GCG | 18 | 5 | 0.36 | 959 |
| 577 | CCAN{3}GGC | 62 | 34 | 0.36 | 960 |
| 578 | CCCN{11}GGC | 57 | 30 | 0.35 | 961 |
| 579 | ACGN{5}GCA | 23 | 8 | 0.35 | 962 |
| 580 | CCCN{14}CGG | 23 | 8 | 0.35 | 963 |
| 581 | CCCN{5}CCA | 91 | 55 | 0.35 | 964 |
| 582 | CCGN{1}AGG | 22 | 7 | 0.34 | 965 |
| 583 | GGGN{10}GAC | 45 | 22 | 0.34 | 966 |
| 584 | CGCN{15}CCA | 20 | 6 | 0.34 | 967 |
| 585 | CCTN{19}CGC | 22 | 7 | 0.34 | 968 |
| 586 | CGTN{3}CGC | 10 | 2 | 0.33 | 969 |
| 587 | AGCN{14}CCG | 21 | 7 | 0.33 | 970 |
| 588 | GGCN{2}CGA | 17 | 5 | 0.33 | 971 |
| 589 | CAGN{8}CCC | 79 | 46 | 0.33 | 972 |
| 590 | CCGN{2}GAC | 16 | 4 | 0.33 | 973 |
| 591 | AGCN{19}AGG | 70 | 40 | 0.32 | 974 |
| 592 | CCTN{4}GGC | 64 | 35 | 0.32 | 975 |
| 593 | CCGN{11}AGC | 22 | 7 | 0.32 | 976 |
| 594 | CACN{4}CGC | 18 | 5 | 0.32 | 977 |
| 595 | CCGN{1}CCC | 30 | 12 | 0.31 | 978 |
| 596 | CTGN{13}GGC | 73 | 42 | 0.31 | 979 |
| 597 | CGCN{16}ACC | 15 | 4 | 0.31 | 980 |
| 598 | CACN{18}CAG | 79 | 46 | 0.31 | 981 |
| 599 | GGCN{8}GCC | 68 | 29 | 0.29 | 982 |
| 600 | GGGN{15}GGA | 78 | 46 | 0.29 | 983 |
| 601 | CCGN{16}GCC | 22 | 7 | 0.29 | 984 |
| 602 | CCGN{20}ACC | 18 | 5 | 0.29 | 985 |
| 603 | CGAN{7}CCC | 17 | 5 | 0.28 | 986 |
| 604 | CCGN{6}CTC | 23 | 8 | 0.28 | 987 |
| 605 | CGGN{10}CTC | 22 | 7 | 0.28 | 988 |
| 606 | CAGN{16}CGC | 23 | 8 | 0.28 | 989 |
| 607 | CCAN{3}AGG | 77 | 45 | 0.27 | 990 |
| 608 | GCCN{18}GCC | 52 | 27 | 0.27 | 991 |

TABLE 5-continued

Dyad patterns over-represented in STAR elements.
The patterns are ranked according to significance coefficient. These were determined using RSA-Tools with the random sequence from the human genome as reference.
Patterns that comprise the most discriminant variables in Linear Discriminant Analysis are indicated with an asterisk
(SEQ ID NOS: 384-1113).

| Number | Dyad sequence | Observed occurrences | Expected occurrences | Significance coefficient | SEQ ID NO: |
|---|---|---|---|---|---|
| 609 | CGCN{18}GGA | 19 | 6 | 0.26 | 992 |
| 610 | CCGN{20}GGC | 22 | 7 | 0.26 | 993 |
| 611 | ACAN{10}GCG | 17 | 5 | 0.26 | 994 |
| 612 | CGGN{5}CCC | 25 | 9 | 0.25 | 995 |
| 613 | CCCN{7}TCC | 75 | 43 | 0.25 | 996 |
| 614 | ACGN{10}CGC | 10 | 2 | 0.25 | 997 |
| 615 | CCCN{3}TCC | 81 | 48 | 0.25 | 998 |
| 616 | CCGN{8}CGG | 20 | 3 | 0.24 | 999 |
| 617 | CCAN{15}CGG | 22 | 7 | 0.24 | 1000 |
| 618 | CCGN{6}CCG | 17 | 5 | 0.24 | 1001 |
| 619 | CAGN{3}GCG | 25 | 9 | 0.24 | 1002 |
| 620 | GAGN{1}CCC | 62 | 34 | 0.24 | 1003 |
| 621 | CCGN{18}TGC | 22 | 7 | 0.23 | 1004 |
| 622 | CCCN{7}CCA | 85 | 51 | 0.23 | 1005 |
| 623 | CGGN{3}CCA | 24 | 9 | 0.23 | 1006 |
| 624 | ACGN{1}CCC | 18 | 5 | 0.23 | 1007 |
| 625 | CGGN{13}TGA | 21 | 7 | 0.22 | 1008 |
| 626 | CTCN{6}GGC | 53 | 28 | 0.22 | 1009 |
| 627 | GCGN{2}GAC | 15 | 4 | 0.22 | 1010 |
| 628 | GGGN{11}ACC | 49 | 25 | 0.22 | 1011 |
| 629 | CGCN{4}GGA | 17 | 5 | 0.22 | 1012 |
| 630 | CCCN{11}CCG | 27 | 10 | 0.22 | 1013 |
| 631 | CCGN{19}GCA | 20 | 6 | 0.22 | 1014 |
| 632 | GCGN{0}GCA | 20 | 6 | 0.21 | 1015 |
| 633 | AGAN{7}CCC | 61 | 33 | 0.21 | 1016 |
| 634 | CGGN{2}CCA | 21 | 7 | 0.21 | 1017 |
| 635 | CCCN{7}CCC | 89 | 54 | 0.21 | 1018 |
| 636 | ACCN{4}GCG | 15 | 4 | 0.2 | 1019 |
| 637 | CCTN{15}CGC | 20 | 6 | 0.2 | 1020 |
| 638 | AGCN{9}GTC | 44 | 21 | 0.2 | 1021 |
| 639 | CCCN{18}CTC | 74 | 43 | 0.2 | 1022 |
| 640 | CGCN{18}CGA | 9 | 1 | 0.19 | 1023 |
| 641 | CCCN{15}GCC | 62 | 34 | 0.18 | 1024 |
| 642 | ACCN{11}GGC | 45 | 22 | 0.18 | 1025 |
| 643 | AGGN{15}CGC | 29 | 12 | 0.18 | 1026 |
| 644 | GCGN{0}CCA | 27 | 10 | 0.18 | 1027 |
| 645 | GCGN{9}AGC | 18 | 5 | 0.17 | 1028 |
| 646 | GGGN{18}GCA | 59 | 32 | 0.17 | 1029 |
| 647 | CCCN{17}CAG | 77 | 45 | 0.17 | 1030 |
| 648 | CCAN{8}CGG | 22 | 8 | 0.16 | 1031 |
| 649 | CCGN{10}GGC | 21 | 7 | 0.16 | 1032 |
| 650 | GCAN{0}GCC | 76 | 44 | 0.16 | 1033 |
| 651 | CAGN{2}CGC | 20 | 6 | 0.16 | 1034 |
| 652 | CGCN{8}GGC | 19 | 6 | 0.16 | 1035 |
| 653 | CTGN{17}GGC | 65 | 36 | 0.16 | 1036 |
| 654 | GGGN{14}ACC | 46 | 23 | 0.16 | 1037 |
| 655 | CCGN{1}TGC | 20 | 6 | 0.16 | 1038 |
| 656 | CAGN{8}CGC | 22 | 8 | 0.15 | 1039 |
| 657 | AAGN{11}CGC | 17 | 5 | 0.15 | 1040 |
| 658 | CCGN{6}TCC | 22 | 8 | 0.14 | 1041 |
| 659 | CCAN{18}CCC | 72 | 42 | 0.14 | 1042 |
| 660 | CCAN{0}CCC | 84 | 51 | 0.14 | 1043 |
| 661 | GAGN{6}CCC | 53 | 28 | 0.14 | 1044 |
| 662 | AGCN{20}GGC | 52 | 27 | 0.14 | 1045 |
| 663 | CAGN{0}CGC | 21 | 7 | 0.14 | 1046 |
| 664 | CCGN{12}CTC | 22 | 8 | 0.14 | 1047 |
| 665 | CGCN{15}ACG | 9 | 1 | 0.13 | 1048 |
| 666 | GGCN{17}CGA | 15 | 4 | 0.13 | 1049 |
| 667 | CCGN{16}AAG | 19 | 6 | 0.13 | 1050 |
| 668 | CGCN{14}TCC | 19 | 6 | 0.12 | 1051 |
| 669 | AGGN{7}CGC | 20 | 7 | 0.12 | 1052 |
| 670 | CGGN{7}CCC | 22 | 8 | 0.12 | 1053 |
| 671 | CGCN{4}GCC | 34 | 15 | 0.12 | 1054 |
| 672 | CGAN{6}CCC | 17 | 5 | 0.12 | 1055 |

TABLE 5-continued

Dyad patterns over-represented in STAR elements.
The patterns are ranked according to significance coefficient. These were determined using RSA-Tools with the random sequence from the human genome as reference.
Patterns that comprise the most discriminant variables in Linear Discriminant Analysis are indicated with an asterisk
(SEQ ID NOS: 384-1113).

| Number | Dyad sequence | Observed occurrences | Expected occurrences | Significance coefficient | SEQ ID NO: |
|---|---|---|---|---|---|
| 673 | CCCN{19}GGA | 60 | 33 | 0.11 | 1056 |
| 674 | CCCN{16}GCG | 28 | 11 | 0.11 | 1057 |
| 675 | CCAN{7}CGC | 20 | 7 | 0.11 | 1058 |
| 676 | CCCN{6}GCC | 80 | 48 | 0.11 | 1059 |
| 677 | GCCN{14}TCC | 55 | 29 | 0.11 | 1060 |
| 678 | AGGN{14}GCC | 64 | 36 | 0.1 | 1061 |
| 679 | CGCN{11}GCC | 20 | 7 | 0.1 | 1062 |
| 680 | TCCN{0}GCA | 17 | 5 | 0.09 | 1063 |
| 681 | GCGN{8}CCC | 27 | 11 | 0.09 | 1064 |
| 682 | CCAN{11}GCG | 19 | 6 | 0.09 | 1065 |
| 683 | CACN{4}GGG | 51 | 26 | 0.09 | 1066 |
| 684 | CGGN{7}TCC | 20 | 7 | 0.09 | 1067 |
| 685 | GCGN{5}GCC | 20 | 7 | 0.09 | 1068 |
| 686 | ACGN{12}CAG | 26 | 10 | 0.09 | 1069 |
| 687 | CCGN{19}CGC | 14 | 4 | 0.08 | 1070 |
| 688 | CGGN{8}TGC | 18 | 5 | 0.08 | 1071 |
| 689 | CCCN{1}GAG | 65 | 37 | 0.07 | 1072 |
| 690 | GCGN{19}TGA | 18 | 6 | 0.07 | 1073 |
| 691 | GGCN{15}GCC | 70 | 31 | 0.07 | 1074 |
| 692 | CCGN{7}CCC | 27 | 11 | 0.07 | 1075 |
| 693 | ACAN{19}CCC | 63 | 35 | 0.07 | 1076 |
| 694 | ACCN{16}GGG | 47 | 24 | 0.07 | 1077 |
| 695 | AGAN{1}GGC | 64 | 36 | 0.07 | 1078 |
| 696 | GGGN{17}TGA | 64 | 36 | 0.06 | 1079 |
| 697 | CAGN{5}GGG | 83 | 50 | 0.06 | 1080 |
| 698 | GCCN{13}CGC | 22 | 8 | 0.06 | 1081 |
| 699 | GCGN{7}GGA | 19 | 6 | 0.06 | 1082 |
| 700 | CAGN{14}CCA | 94 | 58 | 0.06 | 1083 |
| 701 | CCGN{4}GTC | 16 | 4 | 0.06 | 1084 |
| 702 | CCCN{13}CGC | 22 | 8 | 0.06 | 1085 |
| 703 | GCCN{14}ACC | 15 | 4 | 0.05 | 1086 |
| 704 | CAGN{20}GGG | 81 | 49 | 0.05 | 1087 |
| 705 | CCGN{4}CCC | 27 | 11 | 0.05 | 1088 |
| 706 | CGCN{5}GGC | 18 | 6 | 0.05 | 1089 |
| 707 | CCTN{6}GGC | 57 | 31 | 0.05 | 1090 |
| 708 | AGGN{3}GGC | 67 | 38 | 0.05 | 1091 |
| 709 | CGGN{11}CGC | 14 | 4 | 0.05 | 1092 |
| 710 | CTGN{18}GGA | 77 | 46 | 0.04 | 1093 |
| 711 | CACN{17}CCA | 74 | 43 | 0.04 | 1094 |
| 712 | CGGN{3}GAG | 22 | 8 | 0.04 | 1095 |
| 713 | CCCN{9}CCA | 82 | 49 | 0.03 | 1096 |
| 714 | CCCN{1}ACG | 18 | 6 | 0.03 | 1097 |
| 715 | CAGN{1}GCC | 72 | 42 | 0.03 | 1098 |
| 716 | AGGN{6}CCG | 23 | 8 | 0.03 | 1099 |
| 717 | AGCN{9}GGG | 57 | 31 | 0.03 | 1100 |
| 718 | CCCN{7}GGC | 54 | 29 | 0.02 | 1101 |
| 719 | CCTN{13}CCC | 88 | 54 | 0.02 | 1102 |
| 720 | CCGN{19}TTC | 20 | 7 | 0.02 | 1103 |
| 721 | CCCN{7}CCG | 27 | 11 | 0.02 | 1104 |
| 722 | CGAN{6}GGC | 17 | 5 | 0.01 | 1105 |
| 723 | CGGN{4}CTC | 21 | 7 | 0.01 | 1106 |
| 724 | CGGN{0}CGC | 13 | 3 | 0.01 | 1107 |
| 725 | CCTN{13}ACG | 19 | 6 | 0.01 | 1108 |
| 726 | GGGN{6}CAC | 53 | 28 | 0.01 | 1109 |
| 727 | CCCN{16}CGC | 21 | 7 | 0.01 | 1110 |
| 728 | CCCN{10}CTC | 76 | 45 | 0 | 1111 |
| 729 | CCCN{0}CAG | 92 | 57 | 0 | 1112 |
| 730 | GCCN{5}CCC | 65 | 37 | 0 | 1113 |

TABLE 6

STAR elements, including genomic location and length (SEQ ID NOS: 1-66)

| STAR | Location[1] | Length[2] | SEQ ID NO: |
|---|---|---|---|
| 1 | 2q31.1 | 750 | 1 |
| 2 | 7p15.2 | 916 | 2 |
| 3[3] | 15q11.2 and 10q22.2 | 2132 | 3 |
| 4 | 1p31.1 and 14q24.1 | 1625 | 4 |
| 5[4] | 20q13.32 | 1571 | 5 |
| 6 | 2p21 | 1173 | 6 |
| 7 | 1q34 | 2101 | 7 |
| 8 | 9q32 | 1839 | 8 |
| 9[4] | 10p15.3 | 1936 | 9 |
| 10 | Xp11.3 | 1167 | 10 |
| 11 | 2p25.1 | 1377 | 11 |
| 12 | 5q35.3 | 1051 | 12 |
| 13[4] | 9q34.3 | 1291 | 13 |
| 14[4] | 22q11.22 | 732 | 14 |
| 15 | 1p36.31 | 1881 | 15 |
| 16 | 1p21.2 | 1282 | 16 |
| 17 | 2q31.1 | 793 | 17 |
| 18 | 2q31.3 | 497 | 18 |
| 19 | 6p22.1 | 1840 | 19 |
| 20 | 8p13.3 | 780 | 20 |
| 21 | 6q24.2 | 620 | 21 |
| 22 | 2q12.2 | 1380 | 22 |
| 23 | 6p22.1 | 1246 | 23 |
| 24 | 1q21.2 | 948 | 24 |
| 25[5] | 1q21.3 | 1067 | 25 |
| 26 | 1q21.1 | 540 | 26 |
| 27 | 1q23.1 | 1520 | 27 |
| 28 | 22q11.23 | 961 | 28 |
| 29 | 2q13.31 | 2253 | 29 |
| 30 | 22q12.3 | 1851 | 30 |
| 31 | 9q34.11 and 22q11.21 | 1165 | 31 |
| 32 | 21q22.2 | 771 | 32 |
| 33 | 21q22.2 | 1368 | 33 |
| 34 | 9q34.14 | 755 | 34 |
| 35 | 7q22.3 | 1211 | 35 |
| 36 | 21q22.2 | 1712 | 36 |
| 37 | 22q11.23 | 1331 | 37 |
| 38 | 22q11.1 and 22q11.1 | ~1000 | 38 |
| 39 | 22q12.3 | 2331 | 39 |
| 40 | 22q11.21 | 1071 | 40 |
| 41 | 22q11.21 | 1144 | 41 |
| 42 | 22q11.1 | 735 | 42 |
| 43 | 14q24.3 | 1231 | 43 |
| 44 | 22q11.1 | 1591 | 44 |
| 45 | 22q11.21 | 1991 | 45 |
| 46 | 22q11.23 | 1871 | 46 |
| 47 | 22q11.21 | 1082 | 47 |
| 48 | 22q11.22 | 1242 | 48 |
| 49 | Chr 12 random clone, and 3q26.32 | 1015 | 49 |
| 50 | 6p21.31 | 2361 | 50 |
| 51 | 5q21.3 | 2289 | 51 |
| 52 | 7p15.2 | 1200 | 52 |
| 53 | Xp11.3 | 1431 | 53 |
| 54 | 4q21.1 | 981 | 54 |
| 55 | 15q13.1 | 501 | 55 |
| 56 | includes 3p25.3 | 741 | 56 |
| 57 | 4q35.2 | 1371 | 57 |
| 58 | 21q11.2 | 1401 | 58 |
| 59 | 17 random clone | 872 | 59 |
| 60 | 4p16.1 and 6q27 | 2068 | 60 |
| 61 | 7p14.3 and 11q25 | 1482 | 61 |
| 62 | 14q24.3 | 1011 | 62 |
| 63 | 22q13.3 | 1421 | 63 |
| 64 | 17q11.2 | 1414 | 64 |
| 65 | 7q21.11 = 28.4 | 1310 | 65 |
| 66 | 20q13.33 and 6q14.1 | ~2800 | 66 |

[1]Chromosomal location is determined by BLAST search of DNA sequence data from the STAR elements against the human genome database. The location is given according to standard nomenclature referring to the cytogenetic ideogram of each chromosome; e.g., 1p2.3 is the third cytogenetic sub-band of the second cytogenetic band of the short arm of chromosome 1 (http://www.ncbi.nlm.nih.gov/Class/MLACourse/Genetics/chrombanding-.html). In cases where the forward and reverse sequencing reaction identified DNAs from different genomic loci, both loci are shown.
[2]Precise lengths are determined by DNA sequence analysis; approximate lengths are determined by restriction mapping.
[3]Sequence and location of STAR3 (SEQ ID NO: 3) has been refined since assembly of Tables 2 and 4 of EP 01202581.3.
[4]The STARs with these numbers in Tables 2 and 4 of EP 01202581.3 have been set aside (hereafter referred to as "oldSTAR5" etc.) and their numbers assigned to the STAR elements shown in the DNA sequence appendix. In the case of oldSTAR5, oldSTAR14, and oldSTAR16, the cloned DNAs were chimeras from more than two chromosomal locations; in the case of oldSTAR9 and oldSTAR13, the cloned DNAs were identical to STAR4 (SEQ ID NO: 4).
[5]Identical to Table 4 "STAR18" (SEQ ID NO: 18) of EP 01202581.3.

TABLE 7

STAR elements convey stability over time on transgene expression[1]

| | Cell Divisions[2] | Luciferase Expression[3] |
|---|---|---|
| STAR6 (SEQ ID NO: 6) plus puromycin | 42 | 18,000 |
| | 60 | 23,000 |
| | 84 | 20,000 |
| | 108 | 16,000 |
| STAR6 (SEQ ID NO: 6) without puromycin[4] | 84 | 12,000 |
| | 108 | 15,000 |
| | 144 | 12,000 |

[1]Plasmid pSDH-Tet-STAR6 was transfected into U-2 OS cells, and clones were isolated and cultivated in doxycycline-free medium. Cells were transferred to fresh culture vessels weekly at a dilution of 1:20.
[2]The number of cell divisions is based on the estimation that in one week the culture reaches cell confluence, which represents ~6 cell divisions.
[3]Luciferase was assayed as described in Example 4.
[4]After 60 cell divisions the cells were transferred to two culture vessels; one was supplied with culture medium that contained puromycin, as for the first 60 cell divisions, and the second was supplied with culture medium lacking antibiotic.

TABLE 8

Human STAR elements and their putative mouse orthologs and paralogs

| Number | STAR | Human[1] | Mouse[2] | Similarity[3] | SEQ ID NO: |
|---|---|---|---|---|---|
| 1 | 1 | 2q31.1 | 2D | 600 bp 69% | 1 |
| 2 | 2 | 7p15.2 | 6B3 | 909 bp 89% | 2 |
| 3 | 3a | 5q33.3 | 11B2 | 248 bp 83% | 3 |
| 4 | 3b | 10q22.2 | 14B | 1. 363 bp 89% | 3 |
| | | | | 2. 163 bp 86% | |
| 5 | 6 | 2p21 | 17E4 | 437 bp 78% | 6 |
| 6 | 12 | 5q35.3 | 11b1.3 | 796 bp 66% | 12 |
| 7 | 13 | 9q34.3 | 2A3 | 753 bp 77% | 13 |
| 8 | 18 | 2q31.3 | 2E1 | 497 bp 72% | 18 |
| 9 | 36 | 21q22.2 | 16C4 | 166 bp 79% | 36 |
| 10 | 40 | 22q11.1 | 6F1 | 1. 270 bp 75% | 40 |
| | | | | 2. 309 bp 70% | |
| 11 | 50 | 6p21.31 | 17B1 | 1. 451 bp 72% | 50 |
| | | | | 2. 188 bp 80% | |
| | | | | 3. 142 bp 64% | |

TABLE 8-continued

Human STAR elements and their putative mouse orthologs and paralogs

| Number | STAR | Human[1] | Mouse[2] | Similarity[3] | SEQ ID NO: |
|---|---|---|---|---|---|
| 12 | 52 | 7p15.2 | 6B3 | 1. 846 bp 74% | 52 |
|  |  |  |  | 2. 195 bp 71% |  |
| 13 | 53 | Xp11.3 | XA2 | 364 bp 64% | 53 |
| 14 | 54 | 4q21.1 | 5E3 | 1. 174 bp 80% | 54 |
|  |  |  |  | 2. 240 bp 73% |  |
|  |  |  |  | 3. 141 bp 67% |  |
|  |  |  |  | 4. 144 bp 68% |  |
| 15 | 61a | 7p14.3 | 6B3 | 188 bp 68% | 61 |

[1]Cytogenetic location of STAR element in the human genome.
[2]Cytogenetic location of STAR element ortholog in the mouse genome.
[3]Length of region(s) displaying high sequence similarity, and percentage similarity. In some cases more than one block of high similarity occurs; in those cases, each block is described separately. Similarity <60% is not considered significant.

TABLE 9

Candidate STAR elements tested by Linear Discriminant Analysis (SEQ ID NOS: 66-84)

| Candidate STAR | Location[1] | Length | SEQ ID NO: |
|---|---|---|---|
| T2 F | 20q13.33 | ~2800 | 66 |
| T2 R | 6q14.1 | ~2800 | 67 |
| T3 F | 15q12 | ~2900 | 68 |
| T3 R | 7q31.2 | ~2900 | 69 |
| T5 F | 9q34.13 | ND[2] | 70 |
| T5 R | 9q34.13 | ND | 71 |
| T7 | 22q12.3 | ~1200 | 72 |
| T9 F | 21q22.2 | ~1600 | 73 |
| T9 R | 22q11.22 | ~1600 | 74 |
| T10 F | 7q22.2 | ~1300 | 75 |
| T10 R | 6q14.1 | ~1300 | 76 |
| T11 F | 17q23.3 | ~2000 | 77 |
| T11 R | 16q23.1 | ~2000 | 78 |
| T12 | 4p15.1 | ~2100 | 79 |
| T13 F | 20p13 | ~1700 | 80 |
| T13 R | 1p13.3 | ~1700 | 81 |
| T14 R | 11q25 | ~1500 | 82 |
| T17 | 2q31.3 | ND | 83 |
| T18 | 2q31.1 | ND | 84 |

[1]Chromosomal location is determined by BLAT search of DNA sequence data from the STAR elements against the human genome database. The location is given according to standard nomenclature referring to the cytogenetic ideogram of each chromosome; e.g., 1p2.3 is the third cytogenetic sub-band of the second cytogenetic band of the short arm of chromosome 1 (http://www.ncbi.nlm.nih.gov/Class/MLACourse/Genetics/chrombanding-.html). F, forward sequencing reaction result; R, reverse sequencing reaction result. When the forward and reverse sequencing results mapped to different genomic locations, each sequence was extended to the full length of the original clone (as determined by restriction mapping) based on sequence information from the human genome database.
[2]ND: Not Determined.

TABLE 10

Arabidopsis STAR elements of the invention, including chromosome location and length (SEQ ID NOS: 85-119).

| STAR | Chromosome | Length, kb | SEQ ID NO: |
|---|---|---|---|
| A1 | I | 1.2 | 85 |
| A2 | I | 0.9 | 86 |
| A3 | I | 0.9 | 87 |
| A4 | I | 0.8 | 88 |
| A5 | I | 1.3 | 89 |
| A6 | I | 1.4 | 90 |
| A7 | II | 1.2 | 91 |
| A8 | II | 0.8 | 92 |
| A9 | II | 0.9 | 93 |
| A10 | II | 1.7 | 94 |
| A11 | II | 1.9 | 95 |
| A12 | II | 1.4 | 96 |
| A13 | II | 1.2 | 97 |
| A14 | II | 2.1 | 98 |
| A15 | II | 1.4 | 99 |
| A16 | II | 0.7 | 100 |
| A17 | II | 1.5 | 101 |
| A18 | III | 1.5 | 102 |
| A19 | III | 0.7 | 103 |
| A20 | III | 2.0 | 104 |
| A21 | IV | 1.8 | 105 |
| A22 | IV | 0.8 | 106 |
| A23 | IV | 0.6 | 107 |
| A24 | IV | 0.5 | 108 |
| A25 | V | 0.9 | 109 |
| A26 | V | 1.9 | 110 |
| A27 | V | 1.1 | 111 |
| A28 | V | 1.6 | 112 |
| A29 | V | 0.9 | 113 |
| A30 | V | 2.0 | 114 |
| A31 | V | 2.0 | 115 |
| A32 | V | 1.3 | 116 |
| A33 | V | 0.9 | 117 |
| A34 | I | 0.9 | 118 |
| A35 | II | 1.1 | 119 |

REFERENCES

Aranda A. and Pascual A. (2001) Nuclear hormone receptors and gene expression. *Physiol. Rev.* 81, 1269-304.

Berger J., Hauber J., Hauber R., Geiger R. and Cullen B. R. (1988) Secreted placental alkaline phosphatase: a powerful new quantitative indicator of gene expression in eukaryotic cells. *Gene* 66, 1-10.

Bell A. C., West A. G. and Felsenfeld G. (2001) Insulators and boundaries: versatile regulatory elements in the eukaryotic genome. *Science* 291, 447-50.

Bevan M., Mayer K., White O., Eisen J. A., Preuss D., Bureau T., Salzberg S. L. and Mewes H. W. (2001) Sequence and analysis of the *Arabidopsis* genome. *Curr. Opin. Plant Biol.* 4, 105-10.

Boivin A. and Dura J. M. (1998) In vivo chromatin accessibility correlates with gene silencing in *Drosophila*. *Genetics* 150, 1539-49.

Boshart M., Weber F., Jahn G., Dorsch-Hasler K., Fleckenstein B. and Schaffner W. (1985) A very strong enhancer is located upstream of an immediate early gene of human cytomegalovirus. *Cell* 41, 521-30.

Bunker C. A. and Kingston R. E. (1994) Transcriptional repression by *Drosophila* and mammalian Polycomb group proteins in transfected mammalian cells. *Mol. Cell. Biol.* 14, 1721-1732.

Chan A. and Mak T. W. (1989) Genomic organization of the T cell receptor. *Cancer Detect. Prev.* 14, 261-7.

Chung J. H., Whiteley M. and Felsenfeld G. (1993) A 5' element of the chicken beta-globin domain serves as an insulator in human erythroid cells and protects against position effect in *Drosophila*. *Cell* 74, 505-14.

Chevet E., Cameron P. H., Pelletier M. F., Thomas D. Y. and Bergeron J. J. (2001) The endoplasmic reticulum: integration of protein folding, quality control, signaling and degradation. *Curr. Opin. Struct. Biol.* 11, 120-4.

Das G. C., Niyogi S. K. and Salzman N. P. (1985) SV40 promoters and their regulation. *Prog. Nucleic Acid Res. Mol. Biol.* 32, 217-36.

Deuschle U., Meyer W. K. and Thiesen H. J. (1995) Tetracycline-reversible silencing of eukaryotic promoters. *Mol. Cell. Biol.* 15, 1907-14.

Doll R. F., Crandall J. E., Dyer C. A., Aucoin J. M. and Smith F. I. (1996) Comparison of promoter strengths on gene delivery into mammalian brain cells using AAV vectors. *Gene Ther.* 3, 437-447.

Eszterhas S. K., Bouhassira E. E., Martin D. I. and Fiering S. (2002) Transcriptional interference by independently regulated genes occurs in any relative arrangement of the genes and is influenced by chromosomal integration position. *Mol. Cell. Biol.* 22, 469-79.

European patent application 01202581.3.

Foecking M. K. and Hofstetter H. (1986) Powerful and versatile enhancer-promoter unit for mammalian expression vectors. *Gene* 45, 101-5.

Garrick D., Fiering S., Martin D. I. and Whitelaw E. (1998) Repeat-induced gene silencing in mammals. *Nat. Genet.* 18, 56-9.

Gerasimova T. I. and Corces V. G. (2001) Chromatin insulators and boundaries: effects on transcription and nuclear organization. *Annu. Rev. Genet.* 35, 193-208.

Gill D. R., Smyth S. E., Goddard C. A., Pringle I. A., Higgins C. F., Colledge W. H. and Hyde S. C. (2001) Increased persistence of lung gene expression using plasmids containing the ubiquitin C or elongation factor 1alpha promoter. *Gene Ther.* 8, 1539-46.

Gossen M. and Bujard H. (1992) Tight control of gene expression in mammalian cells by tetracycline-responsive promoters. *Proc. Natl. Acad. Sci. U.S.A.* 89, 5547-51.

Groeneveld E. H. and Burger E. H. (2000) Bone morphogenetic proteins in human bone regeneration. *Eur. J. Endocrinol.* 142, 9-21.

Hamer C. M., Sewalt R. G. A. B., Den Blaauwen J. L., Hendrix M., Satijn D. P. E. and Otte A. P. (2002). A panel of monoclonal antibodies against human Polycomb group proteins. *Hybridoma and Hybridomics* 21, 245-52.

Henthorn P., Zervos P., Raducha M., Harris H. and Kadesch T. (1988) Expression of a human placental alkaline phosphatase gene in transfected cells: use as a reporter for studies of gene expression. *Proc. Natl. Acad. Sci. U.S.A.* 85, 6342-6.

Himes S. R. and Shannon M. F. (2000) Assays for transcriptional activity based on the luciferase reporter gene. *Methods Mol. Biol.* 130, 165-174.

Huberty C. J. (1994) Applied discriminant analysis, Wiley and Sons, New York.

Hynes R. O. (1999) Cell adhesion: old and new questions. *Trends Cell. Biol.* 9, M33-7.

Initiative A. G. (2000) Analysis of the genome sequence of the flowering plant *Arabidopsis thaliana*. *Nature* 408, 796-815.

Izumi M. and Gilbert D. M. (1999) Homogeneous tetracycline-regulatable gene expression in mammalian fibroblasts. *J. Cell. Biochem.* 76, 280-9.

Kain S. R. (1997) Use of secreted alkaline phosphatase as a reporter of gene expression in mammalian cells. *Methods Mol. Biol.* 63, 49-60.

Kaufman R. J. (2000) Overview of vector design for mammalian gene expression. *Mol. Biotechnol.* 16, 151-60.

Kaufman R. J. (1990) Selection and coamplification of heterologous genes in mammalian cells. *Methods in Enzymology* 185, 536-566.

Kaufman R. J. and Sharp P. A. (1982) Construction of a modular dihydrofolate reductase cDNA gene: analysis of signals utilized for efficient expression. *Mol. Cell. Biol.* 2, 1304-19.

Kellum R. and Schedl P. (1992) A group of scs elements function as domain boundaries in an enhancer-blocking assay. *Mol. Cell. Biol.* 12, 2424-2431. Kent W. J. (2002) BLAT—the BLAST-like alignment tool. *Genome Res.* 12, 656-64.

Knofler M., Meinhardt G., Bauer S., Loregger T., Vasicek R., Bloor D. J., Kimber S. J. and Husslein P. (2002) Human Hand1 basic helix-loop-helix (bHLH) protein: extra-embryonic expression pattern, interaction partners and identification of its transcriptional repressor domains. *Biochem. J.* 361, 641-51.

Liu D. T. (1992) Glycoprotein pharmaceuticals: scientific and regulatory considerations, and the US Orphan Drug Act. *Trends Biotechnol.* 10, 114-20.

Lopez de Quinto S. and Martinez-Salas E. (1998) Parameters influencing translational efficiency in aphthovirus IRES-based bicistronic expression vectors. *Gene* 217, 51-6.

Martin D. I. and Whitelaw E. (1996) The vagaries of variegating transgenes. *Bioessays* 18, 919-23.

Martinez-Salas E. (1999) Internal ribosome entry site biology and its use in expression vectors. *Curr. Opin. Biotechnol.* 10, 458-64.

McBurney M. W., Mai T., Yang X. and Jardine K. (2002) Evidence for repeat-induced gene silencing in cultured Mammalian cells: inactivation of tandem repeats of transfected genes. *Exp. Cell. Res.* 274, 1-8.

Meyer P. (2000) Transcriptional transgene silencing and chromatin components. *Plant Mol. Biol.* 43, 221-34.

Migliaccio A. R., Bengra C., Ling J., Pi W., Li C., Zeng S., Keskintepe M., Whitney B., Sanchez M., Migliaccio G. and Tuan D. (2000) Stable and unstable transgene integration sites in the human genome: extinction of the Green Fluorescent Protein transgene in K562 cells. *Gene* 256, 197-214.

Mizuguchi H., Xu Z., Ishii-Watabe A., Uchida E. and Hayakawa T. (2000) IRES-dependent second gene expression is significantly lower than cap-dependent first gene expression in a bicistronic vector. *Mol. Ther.* 1, 376-82.

Morgenstern J. P. and Land H. (1990) Advanced mammalian gene transfer: high titre retroviral vectors with multiple drug selection markers and a complementary helper-free packaging cell line. *Nucleic Acids Res.* 18, 3587-96.

Pahl H. L. and Baeuerle P. A. (1997) The ER-overload response: activation of NF-kappa B. *Trends Biochem. Sci.* 22, 63-7.

Patil C. and Walter P. (2001) Intracellular signaling from the endoplasmic reticulum to the nucleus: the unfolded protein response in yeast and mammals. *Curr. Opin. Cell. Biol.* 13, 349-55.

Petersson K., Ivars F. and Sigvardsson M. (2002) The pT alpha promoter and enhancer are direct targets for transactivation by E box-binding proteins. *Eur. J. Immunol.* 32, 911-20.

Quong M. W., Romanow W. J. and Murre C. (2002) E protein function in lymphocyte development. *Annu. Rev. Immunol.* 20, 301-22.

Rees S., Coote J., Stables J., Goodson S., Harris S. and Lee M. G. (1996) Bicistronic vector for the creation of stable mammalian cell lines that predisposes all antibiotic-resistant cells to express recombinant protein. *Biotechniques* 20, 102-4, 106, 108-10.

Ruezinsky D., Beckmann H. and Kadesch T. (1991) Modulation of the IgH enhancer's cell type specificity through a genetic switch. *Genes Dev.* 5, 29-37.

Sambrook J., Fritsch E. F. and Maniatis T. (1989) *Molecular Cloning: A Laboratory Manual,* Second ed., Cold Spring Harbor Laboratory Press, Plainview N.Y.

Sanger F., Nicklen S. and Coulson A. R. (1977) DNA sequencing with chain-terminating inhibitors. *Proc. Natl. Acad. Sci. U.S.A.* 74, 5463-7.

Schorpp M., Jager R., Schellander K., Schenkel J., Wagner E. F., Weiher H. and Angel P. (1996) The human ubiquitin C promoter directs high ubiquitous expression of transgenes in mice. *Nucleic Acids Res.* 24, 1787-8.

Sheeley D. M., Merrill B. M. and Taylor L. C. (1997) Characterization of monoclonal antibody glycosylation: comparison of expression systems and identification of terminal alpha-linked galactose. *Anal. Biochem.* 247, 102-10.

Stam M., Viterbo A., Mol J. N. and Kooter J. M. (1998) Position-dependent methylation and transcriptional silencing of transgenes in inverted T-DNA repeats: implications for posttranscriptional silencing of homologous host genes in plants. *Mol. Cell. Biol.* 18, 6165-77.

Strutzenberger K., Borth N., Kunert R., Steinfellner W. and Katinger H. (1999) Changes during subclone development and ageing of human antibody-producing recombinant CHO cells. *J. Biotechnol.* 69, 215-26.

Thotakura N. R. and Blithe D. L. (1995) Glycoprotein hormones: glycobiology of gonadotrophins, thyrotrophin and free alpha subunit. *Glycobiology* 5, 3-10.

Umana P., Jean-Mairet J. and Bailey J. E. (1999) Tetracycline-regulated overexpression of glycosyltransferases in Chinese hamster ovary cells. *Biotechnol. Bioeng.* 65, 542-9.

van der Vlag J., den Blaauwen J. L., Sewalt R. G., van Driel R. and Otte A. P. (2000) Transcriptional repression mediated by polycomb group proteins and other chromatin-associated repressors is selectively blocked by insulators. *J. Biol. Chem.* 275, 697-704.

van Helden J., Andre B. and Collado-Vides J. (1998) Extracting regulatory sites from the upstream region of yeast genes by computational analysis of oligonucleotide frequencies. *J. Mol. Biol.* 281, 827-42.

van Helden J., Andre B. and Collado-Vides J. (2000) A web site for the computational analysis of yeast regulatory sequences. *Yeast* 16, 177-87.

van Helden J., Rios A. F. and Collado-Vides J. (2000) Discovering regulatory elements in non-coding sequences by analysis of spaced dyads. *Nucleic Acids Res.* 28, 1808-18.

Vance V. and Vaucheret H. (2001) RNA silencing in plants—defense and counterdefense. *Science* 292, 2277-80.

Venkatesan A. and Dasgupta A. (2001) Novel fluorescence-based screen to identify small synthetic internal ribosome entry site elements. *Mol. Cell. Biol.* 21, 2826-37.

Villemure J. F., Savard N. and Belmaaza A. (2001) Promoter Suppression in Cultured Mammalian Cells can be Blocked by the Chicken beta-Globin Chromatin Insulator 5'HS4 and Matrix/Scaffold Attachment Regions. *J. Mol. Biol.* 312, 963-74.

Whitelaw E., Sutherland H., Kearns M., Morgan H., Weaving L. and Garrick D. (2001) Epigenetic effects on transgene expression. *Methods Mol. Biol.* 158, 351-68.

Wright A. and Morrison S. L. (1997) Effect of glycosylation on antibody function: implications for genetic engineering. *Trends Biotechnol.* 15, 26-32.

Yang T. T., Sinai P., Kitts P. A. and Kain S. R. (1997) Quantification of gene expression with a secreted alkaline phosphatase reporter system. *Biotechniques* 23, 1110-4.

Zink D. and Paro R. (1995) *Drosophila* Polycomb-group regulated chromatin inhibits the accessibility of a transactivator to its target DNA. *Embo. J.* 14, 5660-71.

SEQUENCE LISTING (1113 sequences)

SEQ ID NO: 1 - DNA, 749 bp, homo sapiens
  sequence of STAR1
atgcggtgggggcgcgccagagactcgtgggatccttggcttggatgtttggatctttctgagttgcctgtgccgcgaaagacaggtacatttctgattaggcctgtgaagcctcctggaggaccatctcattaagacgatggtattggagggagagtcacagaaagaactgtggcccctccctcactgcaaaacggaagtgattttattttaatgggagttggaatatgtgagggctgcaggaaccagtctccctccttcttggttggaaaagctggggctggcctcagagacaggttttttggccccgctgggctgggcagtctagtcgaccctttgtagactgtgcacacccctagaagagcaactacccctatacaccaggctggctcaagtgaaaggggctctgggctccagtctggaaaatctggtgtcctggggacctctggtcttgcttctctcctcccctgcactggctctgggtgcttatctctgcagaagcttctcgctagcaaacccacattcagcgccctgtagctgaacacagcacaaaaagccctagagatcaaaagcattagtatgggcagttgagcgggaggtgaatatttaacgcttttgttcatcaataactcgttggctttgacctgtctgaacaagtcgagcaataaggtgaaatgcaggtcacagcgtctaacaaatatgaaaatgtgtatattcaccccggtctccagccggcgcgccaggctccc

SEQ ID NO: 2 - DNA, 883 bp, homo sapiens
  sequence of STAR2
gggtgcttcctgaattcttccctgagaaggatggtggccggtaaggtccgtgtaggtggggtgcggctccccaggccccggcccgtggtggtggccgctgcccagcggcccggcacccccatagtccatggcgcccgaggcagcgtgggggaggtgagttagaccaaagagggctggcccggagttgctcatgggctccacatagctgccccccacgaagacggggcttccctgtatgtgtggggtcccatagctgccgttgccctgcaggccatgagcgtgcgggtcatagtcgggggtgccccctgcgcccgcccctgccgccgtgtagcgcttctgtgggggtggcgggggtgcgcagctgggcagggacgcagggtaggaggcggggggcagcccgtaggtaccctgggggggcttggagaagggcgggggcgactggggctcatacgggacgctgttgaccagcgaatgcatagagttcagatagccaccggctccggggggcacggggctgcgacttggagactggccccccgatgacgttagcatgcccttgcccttctgatcctttttgtacttcatgcggcgattctggaaccagatcttgatctggcgctcagtgaggttcagcagattggccatctccacccggcgcggccggcacaggtagcggttgaagtggaactctttctccagctccaccagctgcgcgctcgtgtaggccgtgcgcgcgcgcttggacgaagcctgccccggcgggctcttgtcgccagcgcagctttcgcctgcgaggacagagagaggaagagcggcgtcaggggctgccgcggccccgcccagcccctgacccagcccggcccctccttccaccaggccccaa

SEQ ID NO: 3 - DNA, 2126 bp, homo sapiens
  sequence of STAR3
atctcgagtactgaaataggagtaaatctgaagagcaaataagatgagccagaaaaccatgaaaagaacagggactaccagttgattccacaaggacattcccaaggtgagaaggccatatacctccactacctgaaccaattctctgtatgcagatttagcaaggttataaggtagcaaaagattagacccaagaaaatagagaacttccaatccagtaaaaatcatagcaaatttattgatgataacaattgtctccaaaggaacaaggcagagtcgtgctagcagaggaagcacgtgagctgaaaacagccaaatctgctttgttttcatgacacaggagcataaagtacacaccaccaactgacctattaaggctgtggtaaaccgattcatagagagaggttctaaatacattggtccctcacaggcaaactgcagttcgctccgaacgtagtccctggaaatttgatgtccagtatagaaaagcagagcagtcaaaaaatatagataaagctgaaccagatgttgcctgggcaatgttagcagcaccacacttaagatataacctcaggctgtggactccctccctggggagcggtgctgccggcggcgggcgggctccgcaactccccggctctctcgcccgccctcccgttctcctcgggcggcggcgggggccgggactgcgccgctcacagcggcggctcttctgcgcccggcctcggaggcagtggcggtggcggccatggcctcctgcgttcgccgatgtcagcatttcgaactgagggtcatctccttgggactggttagacagtgggtgcagcccacggagggcgagttgaagcagggtggggtgtcacctcccccaggaagtccagtgggtcagggaactccctcccctagccaagggaggccgtgagggactgtgcccggtgagagactgtgccctgaggaaaggtgcactctggcccagatactacacttttcccacggtcttcaaaacccgcagaccaggagattccctcgggttcctacaccaccaggaccctgggtttcaaccacaaaaccgggccatttgggcagacacccagctagctgcaagagttgtttttttttttatactcctgtggcacctggaacgccagcgagagagcacctttcactcccctggaaagggggctgaaggcagggacctttagctgcgggctagggggtttggggttgagtgggggaggggagagggaaaaggcctcgtcattggcgtcgtctgcagccaataaggctacgctcctctgctgcgagtagacccaatcctttcctagaggtggagggggcgggtaggtggaagtagaggtggcgcggtatctaggagagagaaaaagggctggaccaataggtgcccggaagaggcggacccagcggtctgttgattggtattggcagtggaccctcccccggggtggtgccggagggggggatgatgggtcgaggggtgtgtttatgtggaagcgagatgaccggcaggaacctgccccaatgggctgcagagtggttagtgagtgggtgacagacagacccgtaggccaacgggtggccttaagtgtctttggtctcctccaatggagcagcggcggggcgggaccgcgactcgggtttaatgagactccattgggctgtaatcagtgtcatgtcggattcatgtcaacgacaacaacagggggacacaaaatggcggcggcttagtcctacccctggcggcggcggcagcggtggcggaggcgacggcactcctccaggcggcagccgcagtttctcaggcagcggcagcgcccccggcaggcgcggtggcggtggcgcgcagccaggtctgtcacccaccccgcgcgttcccagggggaggagactgggcgggaggggggaacagacggggggggattcaggggcttgcgacgcccctcccacaggcctctgcgcgagggtcaccgcggggccgctcggggtcaggctgcccctgagcgtgacggtagggggcgggggaaaggggaggagggacaggccccgcccctcggcagggcctctagggcaagggggcggggctcgaggagcggaggggggcggggcgg

SEQ ID NO: 4 - DNA, 1625 bp, homo sapiens
  sequence of STAR4
gatctgagtcatgttttaaggggaggattcttttggctgctgagttgagattaggttgagggtagtgaaggtaaaggcagtgagaccacgtaggggtcattgcagtaatccaggctggagatgatggtggttcagttggaatagcagtgcatgtgctgtaacaacctcagctgggaagcagtatatgtggcgttatgacctcagctggaacagcaatgcatgtggtggtgtaatgaccccagctgggtagggtgcatgtggtgtaacgacctcagctgggtagcagtgtgtgtgatgtaacaacctcagctgggtagcagtgtacttgataaaatgttggcatactctagatttgttatgagggtagtgccattaaatttctccacaaattggttgtcacgtatgagtgaaaagaggaagtgatggaagacttcagtgcttttggcctgaataaatagaagacgtcatttccagttaatggagacagggaagactaaaggtagggtgggattcagtagagcaggtgttcagttttgaatatgatgaactctgagagaggaaaaactttttctacctcttagtttttgtgactggacttaagaattaaagtgacataagacagagtaacaagacaaaaatatgcgaggttatttaatatttttacttgcagaggggaatcttcaaaagaaaaatgaagacccaaagaagccattagggtcaaaagctcatatgcctttttaagtagaaaatgataaattttaacaatgtgagaagacaaaggtgtttgagctgagggcaataaattgtgggacagtgattaagaaatatatgggggaaatgaaatgataagttattttagtagatttattcttcatatctattttggcttcaacttccagtctctagtgataagaatgttcttctcttcctggtacagagagagcacctttctcatgggaaattttatgaccttgctgtaagtagaaaggggaagatcgatctcctgtttcccagcatcaggatgcaaacatttccctccattccagttctcaaccccatggctgggcctcatggcattccagcatcgctatgagtgcacctttcctgcaggctgcctcgggtagctggtgcactgctaggtcagtctatgtgaccaggagctgggcctctgggcaatgccagttggcagcccccatccctccactgctgggggcctcctatccagaagggcttggtgtgcagaacgatggtgcaccatcatcattccccacttgccatctttcaggggacagccagctgctttgggcgcggcaaaaaacacccaactcactcctcttcaggggcctctggtctgatgccaccacaggacatccttgagtgctgggcagtctgaggacagggaaggagtgatgaccacaaaacaggaatggcagcagcagtgacaggaggaagtcaaaggcttgtgtgtcctggccctgctgagggctggcgagggccctgggatggcgctcagtgcctggtcggctgcaagaggccagccctctgcccatgaggggagctggcagtgaccaagctgcactgccctggtggtgcatttcctgccccactctttccttctaagatcc

SEQ ID NO: 5 - DNA, 1571 bp, homo sapiens
  sequence of STAR5
agcagagatcttatttcccgtattcccttgtggcacagcacctcccacgccaaagcaaaccaaagcaaaggagcccttgatgaggaggggccttcccccaacctggtctcccacaggtcctacatacgtacccaccccagacacacagagctgcttcctgctctcacaccagactgagctgtgcccagacatttcccctagcactaaccaactctttcaaaaatacatttttctctaaaaagaacaagtttaaacaaagttgactcattttaagaactgtttagaagataaccttgtgtttattaattatgtatttgcagaaattggaggcagaaggttaccaacattgcctggtgtccagccaggaggtagagcgtggtggcatccagaaccttcctccaactcctgcctggcgtggtttttattcatctttgtattcccaagaaacttctcagtgtctcaggagtgttaggcactcagtacgtgtttggtagttacatgaatgaatgcataatgactaagtgagttaatggatgaagctaattgtctctcccttttgcttttccagagctttccaaggtgaaagtgttggacactctttcttcatctcagatttaatcaactaagaatgctgcaaattgaacaccagtccacaaaactcaggaatacatgaaaagcattgtgccttatttttaactaactcaaattctatgtcagtctcccttttatgctggatgttggcgctaaatctcagtgggttcctcattctgccagacctgtgtccagtttgggggcttcacatagagccaccccatcacaggagagggaagggtcttgctcttggttgccatcactccaccctcttgtcttccgagctttgatgttcactttccttttcaccactcggaagcttcctgccatgatacattgagacctcaatgttaatgccaattggggtttggggttctcataaactcagaagtccaggaaaatcgcctgctgcctcccacaacactctgagggcattctggaatcctaccacttacctggagcctgctggcctcaactgttttgaagtctgtgtctgggccatgcaggtaaatgggaggatgttctgtggccataaaaatacccgaagtcccacctaaagttgatgcagggtcttctgcatttcattgcaaaattgttctatcatttctatagttttcagcctacagtcaggggccaggactttgcacccttggtaaacctcaatctcttctccttcctggcttctactcctttctccctcaatcccaaatcaaggcccttgattgtctggaggtaggaaagcctggttctggctcatgatatagtctacatcatagcctttgtcatctcatggattcactcaacaaccgtgtgtggatggggccacccaatatgtgccaggagttgaggacacgcagggttatgatgatgaaatagataaggggcccacactcacggaccctgcaggacagtggagctgtggacccagcatgcgagtaaagacccagtgagctcaccagacagatcatttaaatcaggtg

SEQ ID NO: 6 - DNA, 1173 bp, homo sapiens
  sequence of STAR6
tgacccaccacagacatcccctctggcctcctgagtggtttcttcagcacagcttccagagccaaattaaacgttcactctatgtctatagacaaaaagggttttgactaaactctgtgttttagagagggagttaaatgctgttaactttttaggggtgggcgagagggatgacaaataacaacttgtctgaatgttttacatttctccccactgcctcaagaaggttcacaacgaggtcatccatgataaggagtaagacctcccagccggactgtccctcggcccccagaggacactccacagagatatgctaactggacttggagactggctcacactccagagaaaagcatggagcacgagcgcacagagcagggccaaggtcccagggacagaatgtctaggagggagattggggtgagggtaatctgatgcaattactgtggcagctcaacattcaagggagggggaagaaagaaacagtccctgtcaagtaagttgtgcagcagagatggtaagctccaaaatttgaaactttggctgctggaaagttttagggggcagagataagaagacataagagactttgagggtttactacacactagacgctctatgcatttatttatttattatctcttatttattactttgtataactcttataataatcttatgaaaacggaaaccctcatatacccattttacagatgagaaaagtgacaattttgagagcatagctaagaatagctagtaagtaaaggagctgggacctaaaccaaaccctatctcaccagagtacacactctttttttttttccagtgtaattttttttaatttttattttactttaagttctgggatacatgtgcagaaggtatggtttgttacataggtatatgtgtgccatagtggattgctgcacctatcaacccgtcatctaggtttaagccccacatgcattagctatttgtcctgatgctctccctcccctccccacaccagacaggccttggtgtgtgatgttcccctccctgtgtccatgtgttctcactgttcagctcccacttatgagtgagaacgtgtggtatttggttttctgttcctgtgttagtttgctgaggatgatggcttccagcttcatccatgtccctgcaaaggacacgatc

SEQ ID NO: 7 - DNA, 2101 bp, homo sapiens
  sequence of STAR7
atcatgccagcttaggcgacagagtgagactggacataataacaataataataaaaataaataaataaaacaattatctgagaggaaaaatttgattcataataaagagaataaaggtttttggcgtgtttgttttgttttcacctaagaacagctgttcccctcattgggttagttttatttgcaagcagaaatcatctccgcatgatttccagggtgatggaaaactgaatatgaatccaccttctgccatctattcacttgtcacatttaataagacactcatgcctattttagcatgttttcttccctaccaaatgagttagtaacatcaagagattaaaataacacaaataagaacattgaaggtattcaaatgttacatacaaatattaaacacaatattattataattattcctggaaatgacattgcctctactctcaaggtaaaggtcatttttcttgatttaaacttttttctcaagtttgaaatctctaagtttcaacccgtaatctatttgcaagtttgtgcaaattttagggattgaatccatagtaattagtgatttattgtggtgtagggagacaagtcaaaagaatcaggactgctaggtagatgactaaggaaaggatggttcacgaggtgacataaagcactcagaagaaaaaggtcaggaaacggaggacagaaaaaaacctaagttctgctgggtgatgctgaatttgtcatcacaaaatctgcattgtggaagctttagctattgaggagattgctcaagtgtagaactgagaacaataggcagtgaacccgagagaacatcaagagactgagagaaaatgaaccagacttccaggtgctccatgttccaaccaacattttgtattgtcagaaggaattgagaggcaaaaggaaacccaataaaaaataaaacaggaaagggcatacatgattaccaccccttttctcaccagctgctcatggaccagctttctcctagtgctattttcttggtcactgcatcactctgctaacatagtttccccactagctctgaggctgtcccagaggggaagccagctgtcatctccttcttccacactctgttggaggaacctgtcattagcagctccctactaaacgcatttatgacaaacaggcaggagataattaactagaaagtgaacaaactcaaacttcagagcctctcatttgtatgaatgcccttgtaaggtcttgggcctattttaatatttataaatgtgttattttcttctaaagaaaaccaccaaattgtataagctacagaatctgcaaaactgaggtccatccatgcactcaggatacattcatagcatctctgagctggaaaatatcttaaaggtcatatatgtcctccaacactgcaagaatctctctggcagcattcttttaaaatcatcatctaaaagagggaaatccccagctgtgtttggattttgctctgtcacttgtccagtttccccatccataaaagggcaacaatatgaatttcctgataaggtagttgttaatataaatacaaagtgcgtagccacttccctaagaaaaatatggggtttctgcttcacagtctagggagaggaaaaaaaaggggggtcagaagtgattattattatcattctatattggaatgttttcagacataaaaagctcaccacgtcttaggccagacagatgcattatgaaagttaagctaagtcttcctcatcatgagctgcacctatatccccattacttcttctagaactgcataatttatttattctttcttcaaaagtttgagagagccattcttgtcctctaagatttttttttttttttttggagacagagtctccgtctgttgcccaggctggagtgcaatggcactatctcagctcactgcaacctctgcctcccagattcaagtgattctcctgcctcagcctcccgagtagctgggattacaagcacgcaccaccacaaccagctaatttttcgtattttttagtagagacgaggttttaccatgttggccaggctggtcttgaactcctgacctcgggtgatccacccacct

SEQ ID NO: 8 - DNA, 1821 bp, homo sapiens
  sequence of STAR8
gagatcacctcgaagagagtctaacgtccgtaggaacgctctcgggttcacaaggattgaccgaaccccaggatacgtcgctctccatctgaggcttgctccaaatggccctccactattccaggcacgtgggtgtctcccctaactctccctgctctcctgagcccatgctgcctatcacccatcggtgcaggtcctttctgaagagctcgggtggattctctccatcccacttcctttcccaagaaagaagccaccgttccaagacacccaatgggacattccccttccacctccttctccaaagttgcccaggtgttcatcacaggttagggagagaagcccccaggtttcagttacaaggcataggacgctggcatgaacacacacacacacacacacacacacacacacacacacacacgactcgaagaggtagccacaagggtcattaaacacttgacgactgttttccaaaaacgtggatgcagttcatccacgccaaagccaagggtgcaaagcaaacacggaatggtggagagattccagaggctcaccaaaccctctcaggaatattttcctgaccctgggggcagaggttggaaacattgaggacatttcttgggacacacggagaagctgaccgaccaggcattttcctttccactgcaaatgacctatggcgggggcatttcactttcccctgcaaatcacctatggcgaggtacctccccaagcccccacccccacttccgcgaatcggcatggctcggcctctatccgggtgtcactccaggtaggcttctcaacgctctcggctcaaagaaggacaatcacaggtccaagcccaaagcccacacctcttccttttgttatacccacagaagttagagaaaacgccacactttgagacaaattaagagtcctttatttaagccggcggccaaagagatggctaacgctcaaaattctctgggccccgaggaaggggcttgactaacttctataccttggtttaggaaggggaggggaactcaaatgcggtaattctacagaagtaaaaacatgcaggaatcaaaagaagcaaatggttatagagagataaacagttttaaaaggcaaatggttacaaaaggcaacggtaccaggtgcggggctctaaatccttcatgacacttagatataggtgctatgctggacacgaactcaaggctttatgttgttatctcttcgagaaaaatcctgggaacttcatgcactgtttgtgccagtatcttatcagttgattgggctcccttgaaatgctgagtatctgcttacacaggtcaactccttgcggaagggggttgggtaaggagcccttcgtgtctcgtaaattaaggggtcgattggagtttgtccagcattcccagctacagagagccttatttacatgagaagcaaggctaggtgattaaagagaccaacagggaagattcaaagtagcgacttagagtaaaaacaaggttaggcatttcactttcccagagaacgcgcaaacattcaatgggagagaggtcccgagtcgtcaaagtcccagatgtggcgagcccccgggaggaaaaaccgtgtcttccttaggatgcccggaacaagagctaggcttccggagctaggcagccatctatgtccgtgagccggcgggagggagaccgccgggaggcgaagtggggcggggccatccttctttctgctctgctgctgccggggagctcctggctggcgtccaagcggcaggaggccgccgtcctgcagggcgccgtagagtttgcggtgcagagt

SEQ ID NO: 9 - DNA, 1929 bp, homo sapiens
  sequence of STAR9
atgagcccccaaaaatgatcctctggcttatgacaacctgatgcagcccaggaaatgcctgcaacatgcccactagcagctgggaacccctctgtgaggaagagaacgttttacattaagaaaccctttgttttgcagcagagactattcaggtcacacatgtgtggcctctcagttctttgagccatttgaagttctctatccttgctgggaggctgagctctccatggaaacctggtccgatagtgagaggagcagaccctctggaaacacctttttacacctgaccaaagcagccagtcatgggccagtgatgcaacaaggtcaaccggtgcattctggcccctcagaaaagcagcccccgggaaggtcaggaggaggctgctgactccctcttcccctgcagccgccccaagcacacccaggagccctgcaggtttgggttcaccaggtgccagcaggtcccacgatgctgcatttcttacgagctcctggaggatgcagatggtcctggtcagaggctgcattctgagtatcaggagccatggggcaacgtttctgcgattgaggaaggggcatttctggggtgggcagaacaaaggtctttggctgagctggagcatccgcctccatcagtgttttccggcaactgtactatccatcgtcttcccttcccacagctgaccatggctttggaaaatgctctgaaactttcttttcagaagagttgactcccaactccacacttaggggaagtcaagcctacttctcagaattcagagaaggcataaaaaagaattcatttctaaaggccctttagaagtaacttcaggtctgacagcggccagctaatttctggtcgccttccaggaatcttctgactgcaaaaaaaaagcatttaccacctgaacacaaacccagttacagatagaaaaacatagtcatttaaatagaatataagcatctggcctctgcccatcataatggagtaacacaaaaatctattttcaaaaggaaactaaatattattgaccaaaacatgaatggggagacctcagggtgatacagctcttgcctggatggaatttgtaatcaagaggatgagacaggattgtaacttgtgccaatgtgaaagggtttgctcaggtatcattcattttgcttaaatgcatgggtaatttccaaagttctttggagctgaatttcacaatttagtgcaggtcctggtgagcccaccttgacttatctcacagtacaatgcagtggcgtggctacaatgctgggcaagagaagccaatgtcaacagcccaggagtggctgggtccttaccaggctcccaggcatgcttcatggtgggccctgggctgggaggaacagcacctttgcctggtccatgagtatctgggtcaaactctcctgtggacacagaaggccatggcgacaggcattcccaggaaaagaaaagggcagcagctgaaatcgtcaggtggagaaggcagtcatccttgctcagtcaactctaatccggctgcctcctcctcagcttcagggtgaacctctcctaagctgtgtctttggtatctgatgggcattaggtgctggtgaaaaagctggagggtcctttgggatattacagaagcccaatctagccttgtattcaatatctaggcactctcacccctgaagttctacgtttccagatttctgaaaacatgggaaagcatgtgtgtgatgtctgaggtccccctcagcctctggtgtagggttaggagggctctaaagggtggcagctccagtgtcccagtggggcctgaagttggtcccttcccttcccagctcccatccatggtttagcccaatcccttccgtacctaagagtactgcacatggatgctccacgcagagcctctgctccactcccaggaagtg

SEQ ID NO: 10 - DNA, 1167 bp, homo sapiens
  sequence of STAR10
  misc_feature (452)..(1143): "N" stands for any nucleotide on various positions
aggtcaggagttcaagaccagcctggccaacatggtgaaaccctgtccctacaaaaaatacaaaaattagccgggcgtggtggggggcgcctataatcccagctactcaggatgctgagacaggagaattgtttgaacccgggaggtggaggttgcagtgaactgagatcgcgccactgcactccagcctggtgacagagagagactccgtctcaacaacagacaaacaaacaaacaaacaacaacaaaaatgtttactgacagctttattgagataaaattcacatgccataaaggtcaccttctacagtatacaattcagtggatttagtatgttcacaaagttgtacgttgttcaccatctactccagaacatttacatcacccctaaaagaagctctttagcagtcacttctcattctccccagcccctgccaaccacgaatctactntctgtctctattctgaatatttcatataaaggagtcctatcatatgggccttttacgtctaccttctttcacttagcatcatgtttttaagattcatccacagtgtagcacgtgtcagttaattcatttcatcttatggctggataatgctctattgtatgcatatccctcactttgcttatccattcatcaactgattgacatttgggttatttctactttttgactattatgagtaatgctgctatgaacattcctgtaccaatcgttacgtggacatatgctttcaattctcctgagtatgtaactagggttggagttgctgggtcatatgttaactcagtgtttcatttttttgaagaactaccaaatggttttccaaagtggatgcaacactttacattcccaccagcaagatatgaaggttccaatgtctctacatttttgccaacacttgtgattttcttttatttatttatttatttatttatttttgagatggagtctcactctgtcacccaggctggagtgcagtggcacaatttcagctcactgcaatctccacctctcgggctcaagcgatactcctgcctcaacctcccgagtaactgggattacaggcgcccaccaccacaccaagctaattttttgtatttttagtagagacggggtttcatcatgtcggccaggntgtactcgaactctgacctcaagt

SEQ ID NO: 11 - DNA, 1377 bp, homo sapiens
  sequence of STAR11
gattctgggtgggtttgatgatctgagagtcccttgaataaaaagaattctagaaaagctgtgaaacttcacctttcccctattcttaaccttacttgcctttgggaggctgaggcaggaggatgacttaaggccaggagtttgagaatgtagtgagctatgaccacaccggttacactcaagcctgggcgagaccacaacaaaaaccttacctgccaactgctccatgctggaaatttatttcgtttcttggattgtggaaagaactggcttactgaaaaccacacttctctaaaacccttcttccagttaggtgttaagattttaacagcctttcctatctgaataaaaactgcacacaaagtaaacttaagagatgtcaacaactcatctgtttgttacaagatgagtctccatgcttcatcgcctgtggggaatcctcatcagcgtctagtggcaaagactcctgtgtgctcaccgaaacgctccccttcctccagggcacacagtcacatggatttcccatgcaccctggcagctcagcaggagtccatgacttaagaaggccaatggactgtgggtgaagtctgtggacggggaagccacatgcgtcacttccaggcctgggcgtgtgcatcctccactctcttcccctgtgggtgcagaaggcggggcagagggccctgaaaccttggaggtcggtggagcccaaaatgaaggagcgtgggcctctgggtcttcatgtaaatttaggtaacactgaactgtcaggtgaacaagaaataaacgtcaaatgtattcagtcgattagatttggtgatggttgttacagcggttaccctccctcaacataataaattttcaaacaactcataatggctcactcatgtataaaatattccatatgaaatcccgggataacatgcttattctagctcaagcttaatcagagtagtccatctgagggaggagatagtagagggcagcaaggggttgtcactgaagataactagccttgctaaaagaatggttgaagaagtgagctacagatagggtaaatccacatctcagacattctgtgatggtcctgatattatcctaaagtaaaatgtagagttgaaccattttaattagattctagaattctattaatttataagatgggcatttccacaaaggactaaacaaagtacaagaggattaaataatcatccacatgggaggcaccgccttgcactttaaaatgatggagcttatcaagactggctgtggatatctgtccctgggagggttttttcccccatttttttcctttttgagacatgttctcgctatgttgcccaggctggtcttgaactcctgggctcaagtgatcct

SEQ ID NO: 12 - DNA, 1051 bp, homo sapiens
  sequence of STAR12
atcctgcttctgggaagagagtggcctcccttgtgcaggtgactttggcaggaccagcagaaacccaggtttcctgtcaggaggaagtgctcagcttatctctgtgaagggtcgtgataaggcacgaggaggcaggggcttgccaggatgttgcctttctgtgccatatgggacatctcagcttacgttgttaagaaatatttggcaagaagatgcacacagaatttctgtaacgaataggatggagttttaagggttactacgaaaaaaagaaaactactggagaagagggaagccaaacaccaccaagtttgaaatcgattttattggacgaatgtctcactttaaatttaaatggagtccaacttccttttctcacccagacgtcgagaaggtggcattcaaaatgtttacacttgtttcatctgcctttttgctaagtcctggtcccctacctcctttccctcacttcacatttgtcgtttcatcgcacacatatgctcatctttatatttacatatatataatttttatatatggcttgtgaaatatgccagacgagggatgaaatagtcctgaaaacagctggaaaattatgcaacagtggggagattgggcacatgtacattctgtactgcaaagttgcacaacagaccaagtttgttataagtgaggctgggtggtttttattttttctctaggacaacagcttgcctggtggagtaggcctcctgcagaaggcattttcttaggagcctcaacttccccaagaagaggagagggcgagactggagttgtgctggcagcacagagacaagggggcacggcaggactgcagcctgcagaggggctggagaagcggaggctggcacccagtggccagcgaggcccaggtccaagtccagcgaggtcgaggtctagagtacagcaaggccaaggtccaaggtcagtgagtctaaggtccatggtcagtgaggctgagacccagggtccaatgaggccaaggtccagagtccagtaaggccgagatccagggtccagggaggtcaag

SEQ ID NO: 13 - DNA, 1291 bp, homo sapiens
  sequence of STAR13
ctgccctgatcccttaatgcttttggcccagagcaccccgctaagtccaaccccagaggggcctcatccgcaaagcctcgggaagaggacagtgacggaggcggctgccctgtgagctgcacggggcagaatgtccttttggcgtcatgttggatgtccacacatccatatggggtcagttctattaggattccttcgggaagaggtagagggtaggaggggttaagccacgagacgaggcatgcagaggggtggcctggatgggtctgcactgctgtccatgcacacggggagcgttgcaaattgtgcttcccagcccatagtgcccccacagaggagcccgggagtccctggtgggcgtctgtgttcctgcaaggagccagtggagatggccccgtgaactctcatcccccttgccttggtggggtctctggcaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggct

SEQ ID NO: 14 - DNA, 711 bp, homo sapiens
  sequence of STAR14
agcaaggaccagggctctgcctccccagtcagcatgagcagagcagactcctttgagcagagcatcagggcagaaatagaacagtttctgaatgagaaaagacagcatgagacccaaaaatgtgatgggtcagtggagaagaaaccagacacacatgaaaattcggcgaagtcactctcgaaatcccaccaagagccggctacaaaggtggtgcaccggcagggcctgatgggcgtccagaaggagttcgccttctgcagacctcccccggttagcaaagacaaacgtgcagcccagaagcctcaggtccaaggtcacgaccacgaccacgcaggagaaggagggcagcacaaagccagcaacccccaccgcccttcagaagcagtacagaataaaagtgggattaaaaggaacgccagcaccgcaaggaggggaaagcgagtcacgagcgccgtacaggcgcccgaggcgtccgactccagcagcgacgacggcattgaggaggccatccagctgtaccaggtgcagaaaacacacaaggaggccgacggggacccgccccagagggtccagctccaagaggaaagagcacctgcccctcccgcacacagcacaagcagcgccacaaaaagtgccttgccagagacccacaggaaaacacccagcaagaagaagccagtgcccaccaagaccacggaccctggtccaggg

SEQ ID NO: 15 - DNA, 1876 bp, homo sapiens
  sequence of STAR15
cagtacatgcagaactgagtccaaacgagacggacagcaaacccggcagtgggctcccagacattcctgggggaaagggatcctaaccacaggcagttaaagtcatctcctccaaccctctatgacacaggctgtgcgctgtcatttaaaagctgagtgaaatttaacccttttcccatttagaaaaacaaagcgcagctggctgccagcactcatttaattttacataaacgtgctctttgaggctgaagcaaatctgactgattttcaatgtgaaaataaaatgtaaaaactgttcttggaattatttctaaacagaacatcagaatcgtctgaatcatcagaatcggctattttggaaaaatcggattcatcaaacgaatcttcggccaacaactgttagagaacgatgttaacaccacgcataggaatgttacattttctagaatttgacattttcattgacggaaaattactgtatcttgtatatggaaataccactactaaaaacataatgctataaatagaatgatgtcttttgtttccaaagtcaatatactcgagcaatgcaaaaataataataaaagtgagatacttcatggcaaagctgccgcaggataaacattgcagccacaagtgcccccagtattctcggggcaaactggaaaagggctaacaggcaacattttcatgttattctactgagtgcagtaattatttttaaaaatatacatgaataatgaaaaaactgtggtatggttttaaagaaatttccataacctggtgaaactcttcacacagggtaataggttcataaagccttggtcctctgcaaaacaagcatcaacttgacaatgactaaaagaagcaacagcaaaactgtcacgcatttggagccatggcctgggttgggccggtgtaaagctctccgccctctggagcaagtctgggccccagcggctggcatgtgggcactgcagggcctgggttgggcaggtgtgcagctctccgtcatctgagcctagtctgaggcctggtggctggcacgtgggccctgcagggcctctacttctcaccccagctccacttccctccctgccctcactgggtctcacagagccaatgaacactggggtcagattcagggcccagcatccactgcagtgggcactgcccttccacaaggcctggctccaggaagcaacccccacctcagccacacagtagggcaacaggaaatcccattcccccatgccagtgactacaccagggaaggggctcacgtgaggctggccccaggcctgctgtgagaccgcgttgtctatgagcttggatttaaggaacttgggagcaagaagctttctttcattacgggccaccagcagggaaaaaagttagcccaacgcagttgacagtcacacccccaccaggaccccagggcacagaaggagggaagaggacaacagaggatgaggtggggccagcagagggacagagaagagctgcctgccctggaacaggcagaaagcatcccacgtgcaagaaaaagtaggccagctagacttaaaatcagaactaccgctcatcaaaagatagtgtaacatttggggtgctataattttaacatgtcccccaaaaggcatgtgttggaaatttaatccccaacaaaccagggctgggaggtggagcctcatgagaggtggtgaggccatgagggtggagtgaatggatgaatgccattgtctcgggaatgggcctcttctacaaggacgagttcagcccccctttctcttgctcaccctctctttgccctttcgctagggagtgacgtaacaagaaggccctcacaagatgctggcaccttgatcttggactc

SEQ ID NO: 16 - DNA, 1282 bp, homo sapiens
  sequence of STAR16
cgcccacctcggctttccaaagtgctgggattacaggcatgagtcactgcgcccatcctgattccaagtctttagataataacttaactttttcgaccaattgccaatcaggcaatctttgaatctgcctatgacctaggacatccctctccctacaagttgccccgcgtttccagaccaaaccaatgtacatcttacatgtattgattgaagttttacatctccctaaaacatataaaaccaagctatagtctgaccacctcaggcacgtgttctcaggacctccctggggctatggcatgggtcctggtcctcagatttggctcagaataaatctcttcaaatattttccagaattttactcttttcatcaccattacctatcacccataagtcagagttttccacaaccccttcctcagattcagtaatttgctagaatggccaccaaactcaggaaagtattttacttacaattaccaatttattatgaagaactcaaatcaggaatagccaaatggaagaggcatagggaaaggtatggaggaaggggcacaaagcttccatgccctgtgtgcacaccaccctctcagcatcttcatgtgttcaccaactcagaagctcttcaaactttgtcatttaggggtttttatggcagttccactatgtaggcatggttgataaatcactggtcatcggtgatagaactctgtctccagctcctctctctctcctccccagaagtcctgaggtggggctgaaagtttcacaaggttagttgctctgacaaccagcccctatcctgaagctattgaggggtcccccaaaagttaccttagtatggttggaagaggcttattatgaataacaaaagatgctcctatttttaccactagggagcatatccaagtcttgcgggaacaaagcatgttactggtagcaaattcatacaggtagatagcaatctcaattcttgccttctcagaagaaagaatttgaccaagggggcataaggcagagtgagggaccaagataagttttagagcaggagtgaaagtttattaaaaagttttaggcaggaatgaaagaaagtaaagtacatttggaagagggccaagtgggcgacatgagagagtcaaacaccatgccctgtttgatgtttggcttggggtcttatatgatgacatgcttctgagggttgcatccttctcccctgattcttcccttggggtgggctgtccgcatgcacaatggcctgccagcagtagggaggggccgcatg

SEQ ID NO: 17 - DNA, 793 bp, homo sapiens
  sequence of STAR17
atccgaggggaggaggagaagaggaaggcgagcagggcgccggagcccgaggtgtctgcgagaactgttttaaatggttggcttgaaaatgtcactagtgctaagtggcttttcggattgtcttatttattactttgtcaggtttccttaaggagagggtgtgttgggggtgggggaggaggtggactggggaaacctctgcgtttctcctcctcggctgcacagggtgagtaggaaacgcctcgctgccacttaacaatccctctattagtaaatctacgcggagactctatgggaagccgagaaccagtgtcttcttccagggcagaagtcacctgttgggaacggcccccgggtccccctgctgggctttccggctcttctaggcggcctgatttctcctcagccctccacccagcgtccctcagggacttttcacacctccccacccccatttccactacagtctcccagggcacagcacttcattgacagccacacgagccttctcgttctcttctcctctgttccttctctttctcttctcctctgttccttctctttctctgtcataatttccttggtgctttcgccaccttaaacaaaaaagagaaaaaaataaaataaaaaaaacccattctgagccaaagtattttaagatgaatccaagaaagcgacccacatagccctccccacccacggagtgcgccaagacgcacccaggctccatcacagggccgagagcagcgccactctggtcgtacttttgggtcaagagatcttgcaaaagagg

SEQ ID NO: 18 - DNA, 492 bp, homo sapiens
  sequence of STAR18
atctttttgctctctaaatgtattgatgggttgtgttttttttcccacctgctaataaatattacattgcaacattcttccctcaacttcaaaactgctgaactgaaacaatatgcataaaagaaaatcctttgcagaagaaaaaaagctattttctcccactgattttgaatggcacttgcggatgcagttcgcaaatcctattgcctattccctcatgaacattgtgaaatgaaacctttggacagtctgccgcattgcgcatgagactgcctgcgcaaggcaagggtatggttcccaaagcacccagtggtaaatcctaacttattattcccttaaaattccaatgtaacaacgtgggccataaaagagtttctgaacaaaacatgtcatctttgtggaaaggtgtttttcgtaattaatgatggaatcatgctcatttcaaaatggaggtccacgatttgtggccagctgatgcctgcaaattatcct

SEQ ID NO: 19 - DNA, 1840 bp, homo sapiens
  sequence of STAR19
tcacttcctgatattttacattcaaggctagctttatgcatatgcaacctgtgcagttgcacagggctttgtgttcagaaagactagctcttggtttaatactctgttgttgccatcttgagattcattataatataatttttgaatttgtgttttgaacgtgatgtccaatgggacaatggaacattcacataacagaggagacaggtcaggtggcagcctcaattccttgccacccttttcacatacagcattggcaatgccccatgagcacaaaatttgggggaaccatgatgctaagactcaaagcacatataaacatgttacctctgtgactaaaagaagtggaggtgctgacagcccccagaggccacagtttatgttcaaaccaaaacttgcttagggtgcagaaagaaggcaatggcagggtctaagaaacagcccatcatatccttgtttattcatgttacgtccctgcatgaactaatcacttacactgaaaatattgacagaggaggaaatggaaagatagggcaacccatagttctttttccttttagtctttccttatcagtaaaccaaagatagtattggtaaaatgtgtgtgagttaattaatgagttagttttaggcagtgtttccactgttggggtaagaacaaaatatataggcttgtattgagctattaaatgtaaattgtggaatgtcagtgattccaagtatgaattaaatatccttgtatttgcatttaaaattggcactgaacaacaaagattaacagtaaaattaataatgtaaaagtttaatttttacttagaatgacattaaatagcaaataaaagcaccatgataaatcaagagagagactgtggaaagaaggaaaacgtttttattttagtatatttaatgggactttcttcctgatgttttgttttgttttgagagagagggatgtgggggcagggaggtctcattttgttgcccaggctggacttgaactcctgggctccagctatcctgccttagcttcttgagtagctgggactacaggcacacaccacagtgtctgacattttctggattttttttttttttttattttttttgtgagacaggttctggctctgttactcaggttgcagtgcagtggcatgatagcggctcactgcagcctcaacctcctcagcttaagctactctcccacttcagcctcctgagtagccaggactacagttgtgtgccaccacacctgtggctaatttttgtagagatggggtctctccacgttgccgaggctggtctccaactcctggtctcaagcgaacctcctgacttggcctcccgaagtgctgggattacaggcttgagccactgcatccagcctgtcctctgtgttaaacctactccaatttgtctttcatctctacataaacggctcttttcaaagttcccatagacctcactgttgctaatctaataataaattatctgccttttcttacatggttcatcagtagcagcattagattgggctgctcaattcttcttggtatattttcttcatttggcttctggggcatcacactctctttgagttactcattcctcattgatagcttcttcctagtcttctttactggttcttcctcttctccctgactccttaatattgtttttctccccaggctttagttcttagtcctcttctgttatctatttacacccaattctttcagagtctcatccagagtcatgaacttaaacctgtttctgtgcagataattcacattattatatctccagcccagactctcccgcaaactgcagactgatcctactg

SEQ ID NO: 20 - DNA, 780 bp, homo sapiens
  sequence of STAR20
gatctcaagtttcaatatcatgttttggcaaaacattcgatgctcccacatccttacctaaagctaccagaaaggctttgggaactgtcaacagagctacagaaaagtcagtaaagaccaatggacccctcaaacaaaaacagccaagcttttctgccaaaaagatgactgagaagactgttaaagcaaaaaactctgttcctgcctcagatgatggctatccagaaatagaaaaattatttcccttcaatcctctaggcttcgagagttttgacctgcctgaagagcaccagattgcacatctccccttgagtgaagtgcctctcatgatacttgatgaggagagagagcttgaaaagctgtttcagctgggccccccttcacctttgaagatgccctctccaccatggaaatccaatctgttgcagtctcctttaagcattctgttgaccctggatgttgaattgccacctgtttgctctgacatagatatttaaatttcttagtgctttagagtttgtgtatatttctattaataaagcattatttgtttaacagaaaaaaagatatatacttaaatcctaaaataaaataaccattaaaaggaaaaacaggagttataactaataagggaacaaaggacataaaatgggataataatgcttaatccaaaataaagcagaaaatgaagaaaaatgaaatgaagaacagataaatagaaaacaaatagcaatatgaaagacaaacttgaccgggtgtggtggctgatgcctgtaatcc

SEQ ID NO: 21 - DNA, 607 bp, homo sapiens
  sequence of STAR21
gatcaataatttgtaatagtcagtgaatacaaaggggtatatactaaatgctacagaaattccattcctgggtataaatcctagacatatttatgcatatgtacaccaagatatatctgcaagaatgttcacagcaaatctctttgtagtagcaaaaggccaaaaggtctatcaacaagaaaattaatacattgtggcacataatggcatccttatgccaataaaaatggatgaaattatagttaggttcaaaaggcaagcctccagataatttatatcatataattccatgtacaacattcaacaacaagcaaaactaaacatatacaaatgtcagggaaaatgatgaacaaggttagaaaatgattaatataaaaatactgcacagtgataacatttaatgagaaaaaaagaaggaagggcttagggagggacctacagggaactccaaagttcatggtaagtactaaatacataatcaaagcactcaaaatagaaaatattttagtaatgttttagctagttaatatcttacttaaaacaaggtctaggccaggcacggtggctcacacctgtaatcccagcactttgggaggctgaggcgggt

SEQ ID NO: 22 - DNA, 1380 bp, homo sapiens
  sequence of STAR22
cccttgtgatccacccgccttggcctcccaaagtgctgggattacaggcgtgagtcactacgcccggccaccctccctgtatattatttctaagtatactattatgttaaaaaaagtttaaaaatattgatttaatgaattcccagaaactaggattttacatgtcacgttttcttattataaaaataaaaatcaacaataaatatatggtaaaagtaaaaagaaaaacaaaaacaaaaagtgaaaaaaataaacaacactcctgtcaaaaaacaacagttgtgataaaacttaagtgcctgaaaatttagaaacatccttctaaagaagttctgaataaaataaggaataaaataatcacatagttttggtcattggttctgtttatgtgatggattatgtttattgatttgtgtatgttgaacttatctcaatagatgcagacaaggccttgataaaagtttttaacaccttttcatgttgaaaactctcaatagactaggtattgatgaaacatatctcaaaataatagaagctatttatgataaacccatagccaatatcatactgagtgggcaaaagctggaagcattccctttgaaaactggcacaagacaaggatgccctctctcaccactcctattaaatgtagtattggaagttctggccagagcaatcaggcaggagaaagaaaaggtattaaaataggaagagaggaagtcaaattgtctctgtttgcagtaaacatgattgtatatttagaaaaccccattgtctcatcctaaaaactccttaagctgataaacaacttcagcaaagtctcaggatacaaaatcaatgtgcaaaaatcacaagcattcctatacaccgataatagacagcagagagccaaatcatgagtgaagtcccattcacaattgcttcaaagaaaataaaatacttaggaatacaactttcacgggacatgaaggacattttcaaggacaactaaaaaccactgctcaaggaaatgagagaggacacaaagaaatggaaaaacattccatgctcatggaagaatcaatatcatgaaaatggccatactgcccaaagtaatttatagattcaatgctaaccccatcaagccaccattgactttcttcacagaactagaaaaaaactattttaaaactcatatgtagtcaaaaagagtcggtatagccaagacaatcctaagcataaagaacaaagctggatgcatcacgctgacttcaaaccatactacaaggctacagtaaccaaaacagcatggtactggtaccaaaacagatagatagaccgatagaacagaacagaggcctcggaaataacaccacacatctacaaccctttgatcttcaa

SEQ ID NO: 23 - DNA, 1246 bp, homo sapiens
  sequence of STAR23
atcccctcatccttcagggcagctgagcagggcctcgagcagctgggggagcctcacttaatgctcctgggagggcagccagggagcatggggtctgcaggcatggtccagggtcctgcaggcggcacgcaccatgtgcagccgcccccacctgttgctctgcctccgccacctggccatgggcttcagcagccagccacaaagtctgcagctgctgtacatggacaagaagcccacaagcagctagaggaccttgtgttccacgtgcccagggagcatggcccacagcccaaagaccagtcaggagcaggcaggggcttctggcaggcccagctctacctctgtcttcacacagatgggagatttctgttgtgattttgagtgatgtgcccctttggtgacatccaagatagttgctgaagcaccgctctaacaatgtgtgtgtattctgaaaacgagaacttctttattctgaaataattgatgcaaaataaattagtttggatttgaaattctattcatgtaggcatgcacacaaaagtccaacattgcatatgacacaaagaaaagaaaaagcttgcattccttaaatacaaatatctgttaactatatttgcaaatatatttgaatacacttctattatgttacatataatattatatgtatatgtatatataatatacatatatatgttacatataatatacttctattatgttacatataatatttatctataagtaaatacataaatataaagatttgagtagctgtagaacattgtcttatgtgttatcagctactactacaaaaatatctcttccacttatgccagtttgccatataaatatgatcttctcattgatggcccagggcaagagtgcagtgggtacttattctctgtgaggagggaggagaaaagggaacaaggagaaagtcacaaagggaaaactctggtgttgccaaaatgtcaagtttcacatattccgagacggaaaatgacatgtcccacagaaggaccctgcccagctaatgtgtcacagatatctcaggaagcttaaatgatttttttaaaagaaaagagatggcattgtcacttgtttcttgtagctgaggctgtgggatgatgcagatttctggaaggcaaagagctcctgctttttccacaccgagggactttcaggaatgaggccagggtgctgagcactacaccaggaaatccctggagagtgtttttcttactta

SEQ ID NO: 24 - DNA, 939 bp, homo sapiens
  sequence of STAR24
acgaggtcacgagttcgagaccagcctggccaagatggtgaagccctgtctctactaaaaatacaacaagtagccgggcgcggtgacgggcgcctgtaatcccagctactcaggaggctgaagcaggagaatctctagaacccaggaggcggaggtgcagtgagctgagactgccccgctgcactctagcctgggcaacacagcaagactctgtctcaaataaataaataaataaataaataaataaataaataaataaatagaaagggagagttggaagtagatgaaagagaagaaaagaaatcctagatttcctatctgaaggcaccatgaagatgaaggccacctcttctgggccaggtcctcccgttgcaggtgaaccgagttctggcctccattggagaccaaaggagatgactttggcctggctcctagtgaggaagccatgcctagtcctgttctgtttgggcttgatcctgtatcacttgattgtctctcctggactttccatggattccagggatgcaactgagaagtttatttttaatgcacttacttgaagtaagagttattttaaaacattttagcaaaggaaatgaattctgacaggttttgcactgaagacattcacatgtgaggaaaacaggaaaaccactatgctagaaaaagcaaatgctgttgagattgtctcacaaacacaaattgcgtgccagcaggtaggtttgagcctcaggttgggcacattttaccttaagcgcactgttggtggaacttaaggtgactgtaggacttatatatacatacatacatataatatatatacatatttatgtgtatatacacacacacacacacacacacacacagggtcttgctatcttgcccagggtggtctccaactctgggtctcaagcgatcctctgcctccccttcccaaag

SEQ ID NO: 25 - DNA, 1067 bp, homo sapiens
  sequence of STAR25
ataaaaaaataaaaaaccctgctctaatttgcaaaggctctatctttcctcccaaccacctgaaattttagtgaaaacggggcttcctgtaggaaggagtagctagctatcccggtccgctacaggttatcagtgcgtgaataccctgactcctaaggctcaggatttgactgggtcgcctcgtccgactgccccgcccccaacgcggacccacgtcaccgcgcgccagcctgcggccgtcctgacctcgcgggatttgagcttcggtgccaacaaacactcccaccgcggctgcgtccactttacctgccggcggcgaccagcttctgaagaaaagtgtccaccatggtgtcgaggagcttcaccctcgaaatggtagtgccgggtggcacagattccgaagacgacccctcatgccttttttcctcacagccgctgcctagattggcgctacttgcttcggccatgttgaagttgaacctccaaatctaactggcccggcctccccgcctgccggagctcccgattggccgctcccgcgaagggtgcctccgattggaagcagtagaacgtctgtcaccgagcagggcgggggcggggaagtcatcggaggctgagggcagcggggaggcgaggctctgcgcggtgggatgtccgcgaccggaaaaatacgcgcaagccaaagctcgggggctcaataaaaacttttaattacatttcagagacttcgtacagtgcaacagtgaatattcactgttaattttcacaagagtccatttcatcaaacgttcagagagtctgccttttcattcccttgttcctcagtgctccaatcaggtttccagtctcccagaggtttcttttagttttgattaccgaccaaaactccagtttagggagaatggaagtccaccgtcccatccccaccaaaacatatttcagtcaaacccaatcccagtccctaaagaattaggaaagtatgggccaagggtccttttaattatacacacatcacccttaaaactgcgtgtgtgtacgagaaataaagaaaaacacaagaggggctg

SEQ ID NO: 26 - DNA, 540 bp, homo sapiens
  sequence of STAR26
ccccctgacaagccccagtgtgtgatgttccccactctgtgtccatgcattctcattgttcaactcccatctgtgagtgagaacatgcagtgtttggttttctgtccttgagatagtttgctgagaatgatggtttccagcttcatccatgtccttgcaaaggaagtgaacttatccttttttatggcttcatagtattccatggcacatatgtgccacatttttttaatccagtctatcattgatggacatttgggttggttccaagtctttgctattgtgaatagcaccacaattaacatatgtgtgcatgtatacatctttatagtagcatgatttataatccttcgggtatataccctgtaatgggatcgctgggtcaaatggtatttctagttctagatccttgaggaatcaccacactgctttccacaatggttgaactaatttacgctcccaccagcagtgtaaaagcattcctatttctccacgtcctctccagtatctgttgtttcctgactttttaatgatcatcattct

SEQ ID NO: 27 - DNA, 1520 bp, homo sapiens
  sequence of STAR27
cttggccctcacaaagcctgtggccagggaacaattagcgagctgcttattttgctttgtatccccaatgctgggcataatgcctgccattatgagtaatgccggtagaagtatgtgttcaaggaccaaagttgataaataccaaagaatccagagaagggagagaacattgagtagaggatagtgacagaagagatgggaacttctgacaagagttgtgaagatgtactaggcagggggaacagcttaaggagagtcacacaggaccgagctcttgtcaagccggctgccatggaggctgggtggggccatggtagctttcccttccttctcaggttcagagtgtcagccttgaacttctaattcccagaggcatttattcaatgttttcttctaggggcatacctgccctgctgtggaagactttcttccctgtgggtcgccccagtccccagatgagacggtttgggtcagggccaggtgcaccgttgggtgtgtgcttatgtctgatgacagttagttactcagtcattagtcattgagggaggtgtggtaaagatggagatgctgggtcacatccctagagaggtgttccagtatgggcacatgggagggctggaaggataggttactgctagacgtagagaagccacatcctttaacaccctggcttttcccactgccaagatccagaaagtccttgtggtttcgctgctttctcctttttttttttttttttttttctgagatggagtctggctctgtcgcccaggctggagtgcagtggcacgatttcggctcactgcaagttccgcctcctaggttcataccattctcccacctcagcctcccgagtagctgggactacaggcgccaccacacccagctaattttttgtatttttagtagagacggcgtttcaccatgttagccaggatggtcttgatccgcctgcctcagcctcccaaagtgctgggattacaggcgtgagccaccgcgcccggcctgctttcttctttcatgaagcattcagctggtgaaaaagctcagccaggctggtctggaactcttgacctcaagtgatctgcctgcctcagcctcccaaagtgctgagattacaggcatgagccagtccgaatgtggctttttttgttttgttttgaaacaaggtctcactgttgcccaggctgcagtgcagtggcatacctcagctccactgcagcctcgacctcctgggctcaagcaatcctcccaactgagcctccccagtagctggggctacaagcgcatgccaccacgcctggctatttttttttttttttttttttttgagaaggagtttcattcttgttgcccaggctggagtgcaatggcacagtctcagctcactgcagcctccgcctcctgggttcaagcgattctcctgcctcagcctcccgagtagctgggattataggcacctgccaccatgcctggctaatttttttgtatttttagtagggatggggtttcaccatgtt

SEQ ID NO: 28 - DNA, 961 bp, homo sapiens
  sequence of STAR28
aggaggttattcctgagcaaatggccagcctagtgaactggataaatgcccatgtaagatctgtttaccctgagaagggcatttcctaactctccctataaaatgccaagtggagcaccccagatgaaatagctgatatgctttctatacaagccatctaggactggctttatcatgaccaggatattcacccactgaatatggctattacccaagttatggtaaatgctgtagttaagggggtcccttccacatggacaccccaggttataaccagaaagggttcccaatctagactccaagagagggttcttagacctcatgcaagaaagaacttggggcaagtacataaagtgaaagcaagtttattaagaaagtaaagaaacaaaaaaatggctactccataagcaaagttatttctcacttatatgattaataagagatggattattcatgagttttctgggaaaggggtgggcaattcctggaactgagggttcctcccacttttagaccatatagggtatcttcctgatattgccatggcatttgtaaactgtcatggcactgatgggagtgtcttttagcattctaatgcattataattagcatataatgagcagtgaggatgaccagaggtcacttctgttgccatattggtttcagtggggtttggttggcttttttttttttttaaccacaacctgttttttatttatttatttatttatttatttatttatattttttatttttttttagatggagtcttgctctgtcacccaggttagagtgcagtggcaccatctcggctcactgcaagctctgcctccttggttcacgccattctgctgcctcagcctcccgagtagctgggactacaggtgcctgccaccatacccggctaattttttctatttttcagtagagacggggtttcaccgtgttagccaggatggtc

SEQ ID NO: 29 - DNA, 2233 bp, homo sapiens
  sequence of STAR29
agcttggacacttgctgatgccactttggatgttgaagggccgccctctcccacaccgctggccacttttaaatatgtcccctctgcccagaagggccccagaggaggggctggtgagggtgacaggagttgactgctctcacagcagggggttccggagggaccttttctccccattgggcagcatagaaggacctagaagggccccctccaagcccagctgggcgtgcagggccagcgattcgatgccttcccctgactcaggtggcgctgtcctaaaggtgtgtgtgttttctgttcgccagggggtggcggatacagtggagcatcgtgcccgaagtgtctgagcccgtggtaagtccctggagggtgcacggtctcctccgactgtctccatcacgtcaggcctcacagcctgtaggcaccgctcggggaagcctctggatgaggccatgtggtcatccccctggagtcctggcctggcctgaagaggaggggaggaggaggccagcccctccctagccccaaggcctgcgaggctgcaagcccggccccacattctagtccaggcttggctgtgcaagaagcagattgcctggccctggccaggcttcccagctaggatgtggtatggcaggggtgggggacattgaggggctgctgtagcccccacaacctccccaggtagggtggtgaacagtaggctggacaagtggacctgttcccatctgagattcaagagcccacctctcggaggttgcagtgagccgagatccctccactgcactccagcctgggcaacagagcaagactctgtctcaaaaaaacagaacaacgacaacaaaaaacccacctctggcccactgcctaactttgtaaataaagttttattggcacatagacacacccattcatttacatactgctgcggctgcttttgcattacccttgagtagacgacagaccacgtggccatggaagccaaaaatatttactgtctggccctttacagaagtctgctctagagggagaccccggcccatggggcaggaccactgggcgtgggcagaagggaggcctcggtgcctccacgggcctagttgggtatctcagtgcctgtttcttgcatggagcaccaggggtcagggcaagtacctggaggaggcaggctgttgcccgcccagcactgggacccaggagaccttgagaggctcttaacgaatgggagacaagcaggaccagggctcccattggctgggcctcagtttccctgcctgtaagtgagggagggcagctgtgaaggtgaactgtgaggcagagcctctgctcagccattgcaggggcggctctgccccactcctgttgtgcacccagagtgaggggcacggggtgagatgtcaccatcagcccataggggtgtcctcctggtgccaggtccccaagggatgtcccatcccccctggctgtgtggggacagcagagtccctggggctgggagggctccacactgttttgtcagtggtttttctgaactgttaaatttcagtggaaaattctctttccccttttactgaaggaacctccaaaggaagacctgactgtgtctgagaagttccagctggtgctggacgtcgcccagaaagcccaggtactgccacgggcgccggccaggggtgtgtctgcgccagccatgggcaccagccaggggtgtgtctacgccggccaggggtaggtctccgccggcctccgctgctgcctggggagggccgtgcctgacactgcaggcccggtttgtccgcggtcagctgacttgtagtcaccctgcccttggatggtcgttacagcaactctggtggttggggaaggggcctcctgattcagcctctgcggacggtgcgcgagggtggagctcccctccctccccaccgcccctggccagggttgaacgcccctgggaaggactcaggcccgggtctgctgttgctgtgagcgtggccacctctgccctagaccagagctgggccttccccggcctaggagcagccgggcaggaccacagggctccgagtgacctcagggctgcccgacctggaggccctcctggcgtcgcggtgtgactgacagcccaggagcgggggctgttgtaattgctgtttctccttcacacagaaccttttcgggaagatggctgacatcctggagaagatcaagaagtaagtcccgccccccaccc

SEQ ID NO: 30 - DNA, 1851 bp, homo sapiens
  sequence of STAR30
cctcccctggagccttcagaaggagcatggcataggagtcttgatttcagacgtctggtccccagaatgatgggagaatgaatttctgttatttaagccacccaacctgtggtgctttgttatagcagcctcaggaaactaacacactgcacgtgcccactattcccttttccagtatctttcaggacttgctggcttcctttgttctggcgtacacccatgcatggccccattccccacttcctaaaacaacaaccctgacttagtctgtttgggctgctagaacaaaatactatagactgggtgacttataaacaacagaaattcatttctcacattctggaggctgggaagtccaatatcgaggcaccatcacatttggtctctgctgaggcccccttcctagctcctcactgtgtccttacatggcagaaggggcaaggcagctctctggggtcccttttcaaggccacaaatcccattcattagggctgatgacttcatgacttaatcacctcctaatggccccacctcctaatcgcattgggcgttaggattcaacataaattttggggggacacacatattcagaccatagcaaaccccaacaataaaaaaccttcactttaaggttccaaatggactggcagttaaatcatgttcatatttacataaaagaaggagtaagtcaacaaattgataaacgcgtggagatttgttcggatggatgttcaccaaaatgctggccttaaagagtgagatgggaaatgggaactattacattcttcttcatactttttggtactgcctgcattgttaaaaaaaaaaaaaaagagcacagagcatttttacaatcaggaaaaaaacaatgaggttatcttcattctggaaaaaaatggaaaatgaaacagtggagtcacatcatggaaaatgcttatggtacaatttcatgtgacataaaacaatagaatagaggacctgttttatgactaaagcactgtaaaaatgacaggcctggaaggagagatgaaaaccactcatttgttaaggtagtcaggtggcaggtgatttctcttcttttgaaaatttccattttcattatatcgcagtttgtgcatttactaaaactttcggttggtacacatgcataaatagatagataaataagtagatagatgatagataaatagacggtaggtagatagatagatagatatgagaaataagtcccctgtacttggccttgcagccataactagtcattccccttcctctgtccattgctatgcctgatggacaaggcagtctgtgccctctggccccaattccaatgtgccctctgctcctggctgttagtccctttccaccccaatacaattgctccgaggtcacttctaagtgtgaagcccccagatcagatggcttcttctgtgtccttaccttacccaatttctaattataactaaaacacaatgaggctctagtaaaataccatgagacttcaggccctctgtataacttcactcatttaaacctaacaaggaaaacctaccatgaatccgaggcacagagcagctaaggaactcaccaaggtcacgcagctattggtgatggaaccatgagtcaagcttcacagcctgttggctctagaatagggtttcccaacctcagcactgtggacattttcaggctggataattctctgttgtggggggctgttctgtgccttgtaggatattaggagcatctctggcctctacccactagacgcagcagcactcccatgcccagttgtgacaacaagcaatgtctcccaccattgccaagtgtcccctgggtggaaatgcaccc

SEQ ID NO: 31 - DNA, 1701 bp, homo sapiens
  sequence of STAR31
  misc_feature (159)..(1696): "N" stands for any nucleotide on various positions
cacccgccttggccccccagagtgctgggattacaagtgtaaaccaccattcctggctagatttaattttttaaaaaataaagagaagtaggaatagttcattttagggagagccccttaactgggacaggggcaggacaggggtgaggcttcccttanttcaagctcacctcaaacccacccaggactgtgtgtcacattctccaataaaggaaaggttgctgcccccgcctgtgagtgctgcagtggagggtagagggccgtgggcagagtgcttcatggactgctcatcaagaaaggcttcatgacaatcggcccagctgctgtcatcccacattctacttccagctaggagaaggcggcttgcccacagtcacccagccggcaagtgtcacccctgggttggacccagagctatgatcctgcccaggggtccagctgagaatcaggcccacgttctaggcagaggggctcacctactgggactccagtagctgtagtgcatggaggcatcatggctgcagcagcctggacctggtctcacactggctgtccctgtgggcaggccatcctcaatgccaggtcaggcccaagcatgtatcccagacaatgacaatggggtggaatcctctcttgtcccagaagccactcctcactgttctacctgaggaaggcaggggcatggtggaatcctgaagcctgctgtgagggtctccagcgaacttgcacatggtcagccctgccttctcctccctgaactagattgagcgagagcaagaaggacattgaaccagcacccaaagaattttggggaacggcctctcatccaggtcaggctcacctcctttttaaaatttaattaattaattaattaatttttttttagagacagagtcttactgtgtggcccaggctgtagtgcagtggcacaatcatagttcactgcagcctcaaactccccacctcagcctctggattagctgagactacaggtgcaccaccaccacacccagctaatatttttatttttgtagagagagggtttcaccatcttgcccaggctggtctcaaactcctgggctcaagtgatcccgcccaggtctgaaagcccccaggctggcctcagactgtggggttttccatgcagccacccgagggcgcccccaagccagttcatctcggagtccaggcctggccctgggagacagagtgaaaccagtggtttttatgaacttaacttagagtttaaaagatttctactcgatcacttgtcaagatgcgccctctctggggagaagggaacgtgactggattccctcactgttgtatcttgaataaacgctgctgcttcatcctgtgggggccgtggccctgtccctgtgtgggtggggcctcttccatttccctgacttagaaaccacagtccacctagaacagggtttgagaggcttagtcagcactgggtagcgttttgactccattctcggctttcttctttttctttccaggatttttgtgcagaaatggttcttttgttgccgtgttagtcctccttggaaggcagctcagaaggcccgtgaaatgtcgggggacaggacccccagggagggaaccccaggctacgcactttagggttcgttctccagggagggcgacctgacccccgnatccgtcggngcgcgnngnnacnaannnnttccc

SEQ ID NO: 32 - DNA, 771 bp, homo sapiens
  sequence of STAR32
gatcacacagcttgtatgtgggagctaggattggaaccccagaagtctggccccaggttcatgctctcacccactgcatacaatggcctctcataaatcaatccagtataaaacattagaatctgctttaaaaccatagaattagtagcgtaagtaataaatgcagagaccatgcagtgaatggcattcctggaaaaagcccccagaaggaattttaaatcagctttcgtctaatcttgagcagctagttagcaaatatgagaatacagttgttcccagataatgctttatgtctgaccatcttaaactggcgctgtttttcaaaaacttaaaaacaaaatccatgactcttttaattataaaagtgatacatgtctacttgggaggctgaggtggtgggaggatggcttgagtttgaggctgcagtatgctactatcatgcctataaatagccgctgcattccagcttgggcaacatacccaggccctatctcaaaaaaataaaaagtaatacatctacattgaagaaaattaattttattgggtttttttgcatttttattatacacagcacacacagcacatatgaaaaaatgggtatgaactcaggcattcaactggaagaacagtactaaatcaatgtccatgtagtcagcgtgactgaggttggtttgttttttcttttttcttctcttctcttctcttttctttttttttgagacggagctttgctctttttgcccaggcttgattgcaatggcgtgatctcag

SEQ ID NO: 33 - DNA, 1368 bp, homo sapiens
  sequence of STAR33
gcttttatcctccattcacagctagcctggcccccagagtacccaattctccctaaaaaacggtcatgctgtatagatgtgtgtggcttggtagtgctaaagtggccacatacagagctctgacaccaaacctcaggaccatgttcatgccttctcactgagttctggcttgttcgtgacacattatgacattatgattatgatgacttgtgagagcctcagtcttctatagcacttttagaatgctttataaaaaccatggggatgtcattatattctaacctgttagcacttctgttcgtattacccatcacatcccaacatcaattctcatatatgcaggtacctcttgtcacgcgcgtccatgtaaggagaccacaaaacaggctttgtttgagcaacaaggtttttatttcacctgggtgcaggtgggctgagtctgaaaagagagtcagtgaagggagacaggggtgggtccactttataagatttgggtaggtagtggaaaattacaatcaaagggggttgttctctggctggccagggtgggggtcacaaggtgctcagtgggagagcctttgagccaggatgagccagaaggaatttcacaaggtaatgtcatcagttaaggcagggactggccattttcacttcttttgtggtggaatgtcatcagttaaggcaggaaccggccattttcacttcttttgtgattcttcacttgcttcaggccatctggacgtataggtgcaggtcacagtcacaggggataagatggcaatggcatagcttgggctcagaggcctgacacctctgagaaactaaagattataaaaatgatggtcgcttctattgcaaatctgtgtttattgtcaagaggcacttatttgtcaattaagaacccagtggtagaatcgaatgtccgaatgtaaaacaaaatacaaaacctctgtgtgtgtgtgtgtgtgagtgtgtgtgtatgtgtgtgtgtgtgtattagagaggaaaagcctgtatttggaggtgtgattcttagattctaggttctttcctgcccaccccatatgcacccaccccacaaaagaacaaacaacaaatcccaggacatcttagcgcaacatttcagtttgcatattttacatatttacttttcttacatattaaaaaactgaaaattttatgaacacgctaagttagattttaaattaagtttgtttttacactgaaaataatttaatatttgtgaagaatactaatacattggtatatttcattttcttaaaattctgaacccctcttcccttatttccttttgacccgattggtgtattggtcatgtgactcatggatttgccttaaggcaggagg

SEQ ID NO: 34 - DNA, 755 bp, homo sapiens
  sequence of STAR34
actgggcaccctcctaggcaggggaatgtgagaactgccgctgctctggggctgggcgccatgtcacagcaggagggaggacggtgttacaccacgtgggaaggactcagggtggtcagccacaaagctgctggtgatgaccaggggcttgtgtcttcactctgcagccctaacacccaggctgggttcgctaggctccatcctgggggtgcagaccctgagagtgatgccagtgggagcctcccgcccctccccttcctcgaaggcccaggggtcaaacagtgtagactcagaggcctgagggcacatgtttatttagcagacaaggtggggctccatcagcggggtggcctggggagcagctgcatgggtggcactgtggggagggtctcccagctccctcaatggtgttcgggctggtgcggcagctggcggcaccctggacagaggtggatatgagggtgatgggtggggaaatgggaggcacccgagatggggacagcagaataaagacagcagcagtgctggggggcagggggatgagcaaaggcaggcccaagacccccagcccactgcaccctggcctcccacaagccccctcgcagccgcccagccacactcactgtgcactcagccgtcgatacactggtctgttagggagaaagtccgtcagaacaggcagctgtgtgtgtgtgtgcgtgtatgagtgtgtgtgtgtgatccctgactgccaggtcctctgcactgcccctggg

SEQ ID NO: 35 - DNA, 1193 bp, homo sapiens
  sequence of STAR35
  misc_feature (312)..(1191): "N" stands for any nucleotide on various positions
cgacttggtgatgcgggctcttttttggttccatatgaactttaaagtagtcttttccaattctgtgaagaaagtcattggtaggttgatggggatggcattgaatctgtaaattaccttgggcagtatggccattttcacaatgttgattcttcctatccatgatgatggaatgttcttccattagtttgtatcctcttttatttccttgagcagtggtttgtagttctccttgaagaggtccttcacatcccttgtaagttggattcctaggtattttattctctttgaagcaaattgtgaatgggagtncactcacgatttggctctctgtttgtctgctgggtgtataaanaatgtngtgatnttngtacattgatttngtatccntgagacttngctgaatttgcttnatcngcttnngggaaccttttgggctgaaacnatgggattttctaaatatacaatcatgtcgtctgcaaacagggaacaatttgacttcctcttttcctaattgaatacactttatctccttctcctgcctaattgccctgggcaaaacttccaacactatgntngnaataggagntggtgagagagggcatccctgttcttgttgccagnttttcaaagggaatgcttccagttttggcccattcagtatgatatgggctgtgggtngtgtcataaatagctcttatnattttgaaatgtgtcccatcaatacctaatttattgaaagtttttagcatgaangcatngttgaatttggtcaaaggctttttctgcatctatggaaataatcatgtggtttttgtctttggctcntgtttatatgctggatnacatttattgatttgtgtatatngaacccagcctnncatcccagggatgaagcccacttgatccaagcttggcgcgcngnctagctcgaggcaggcaaaagtatgcaaagcatgcatctcaattagtcagcacccatagtccgcccctacctccgcccatccgcccctaactcngnccgttcgcccattctcgcccatggctgactaatntttttannatccaagcggngccgccctgcttgancattcagagtnnagagnnttggaggccnagccttgcaaaactccggacngnttctnnggattgaccccnnttaaatatttggttttttgtnttttcannggnga

SEQ ID NO: 36 - DNA, 1712 bp, homo sapiens
  sequence of STAR36
gatcccatccttagcctcatcgatacctcctgctcacctgtcagtgcctctggagtgtgtgtctagcccaggcccatcccctggaactcaggggactcaggactagtgggcatgtacacttggcctcaggggactcaggattagtgagccccacatgtacacttggcctcagtggactcaggactagtgagccccacatgtacacttggcctcaggggactcaggattagtgagcccccacatgtacacttggcctcaggggactcaggattagtgagccccacatgtacacttggcctcaggggactcaggactagtgagccccacatgtacacttggcctcaggggactcagaactagtgagccccacatgtacacttggcttcaggggactcaggattagtgagccccacatgtacacttggacacgtgaaccacatcgatgtgctgcagagctcagccctctgcagatgaaatgtggtcatggcattccttcacagtggcacccctcgttccctccccacctcatctcccattcttgtctgtcttcagcacctgccatgtccagccggcagattccaccgcagcatcttctgcagcacccccgaccacacacctccccagcgcctgcttggccctccagcccagctcccgcctttcttccttggggaagctccctggacagacaccccctcctcccagccatggctttttcctgctctgccccacgcgggaccctgccctggatgtgctacaatagacacatcagatacagtccttcctcagcagccggcagacccagggtggactgctcggggcctgcctgtgaggtcacacaggtgtcgttaacttgccatctcagcaactagtgaatatgggcagatgctaccttccttccggttccctggtgagaggtactggtggatgtcctgtgttgccggccaccttttgtccctggatgccatttatttttttccacaaatatttcccaggtctcttctgtgtgcaaggtattagggctgcagcgggggccaggccacagatctctgtcctgagaagacttggattctagtgcaggagactgaagtgtatcacaccaatcagtgtaaattgttaactgccacaaggagaaaggccaggaaggagtggggcatggtggtgttctagtgttacaagaagaagccagggagggcttcctggatgaagtggcatctgacctgggatctggaggaggagaaaaatgtcccaaaagagcagagagcccaccctaggctctgcaccaggaggcaacttgctgggcttatggaattcagagggcaagtgataagcagaaagtccttgggggccacaattaggatttctgtcttctaaagggcctctgccctctgctgtgtgaccttgggcaagttacttcacctctagtgctttggttgcctcatctgtaaagtggtgaggataatgctatcacactggttgagaattgaagtaattattgctgcaaagggcttataagggtgtctaatactagtactagtaggtacttcatgtgtcttgacaattttaatcattattattttgtcatcaccgtcactcttccaggggactaatgtccctgctgttctgtccaaattaaacattgtttatccctgtgggcatctggcgaggtggctaggaaagcctggagctgtttcctgttgacgtgccagactagt

SEQ ID NO: 37 - DNA, 1321 bp, homo sapiens
  sequence of STAR37
atctctctctgccaaagcaacagcggtccctgccccaaccagactaccccactcagtggggttacggatgctgctccagcatcctaacactgcccagctggtgcctgcctgtgctcacccacaacccccaggccggccttccctgcagcctgggcttggccaccttggcctgattgagcactgaggcctcctgggcacccagccccatcactgcacctgctgcttccagccccaccccaccggctcaggggttcttcccagcggcgctgatcatgaagtcaacatgcacgcaagtcgtctcaggaaactttttaatgaaagtgtcggccacggtggtgtgtaggtggctgagctcagattgcagctgctaagacaccagccacttaccaagagaaagccaggctgcttcaaacccagggccggaggcaaaaaagcatcacttccagccggggagtctggaagccacgccttgtgggaggtcacactggcatctaggccttcgcctgcactgcagaaggagagccgggtccccctcctggagaacgctgcgttccccagccccacaccggctttgccaccacacaggctgttgaggcaggaggcgggtaagacgtagctgtagacccaaagcaaccaccagccctgggaccctgcgggagaggagcacttttagaacatggaaaaatgtggtcatcccatcattagacagcacacatcctacataaataaaaagtcgtatggggaaggaggttggggagggaataaaaaattggcacagacattgatagactggtttccagtttcaaggtaacagatgcacatcatgagaccagaggaggcagagacaagggctgaatttggcttttctaagcaacatgtgttcctgcgcagggctgaatggtcgctgagacagagatggaagccaggacaagggagcccaccgggcccagataggtacagagagcagaggctcctgttctgtcctcgccacccatgagggtgacactgcttgtaaatggtggctgtgctctcccagcaagaaaaaagcacaactaaatccacactgcacacagacgcagacagaaagccttcaagtggctctgttttctgctccctgccttgccaggtccacaagcagagaggagtgtcaggcacatggccccgctgtcaggctccccagtgagctgtaggctcagcaggagctgcccactgacacacaggggacacccactcctgccaccttgggagcggttgccagacagagccgcactgggtgctggtgtcatccagggaccccacacacttccttaaatgtgatcct

SEQ ID NO: 38 - DNA, 1445 bp, homo sapiens
  sequence of STAR38
  misc_feature (348)..(949): "N" stands for any nucleotide on various positions
gatctatgggagtagcttccttagtgagctttcccttcaaatactttgcaaccaggtagagaattttggagtgaaggttttgttcttcgtttcttcacaatatggatatgcatcttcttttgaaaatgttaaagtaaattacctctcttttcagatactgtcttcatgcgaacttggtatcctgtttccatcccagccttctataacccagtaacatcttttttgaaaccagtgggtgagaaagacacctggtcaggaacgcggaccacaggacaactcaggctcacccacggcatcagactaaaggcaaacaaggactctgtataaagtaccggtggcatgtgtatnagtggagatgcagcctgtgctctgcagacagggagtcacacagacacttttctataatttcttaagtgctttgaatgttcaagtagaaagtctaacattaaatttgattgaacaattgtatattcatggaatattttggaacggaataccaaaaaatggcaatagtggttctttctggatggaagacaaacttttcttgtttaaaataaattttattttatatatttgaggttgaccacatgaccttaaggatacatatagacagtaaactggttactacagtgaagcaaattaacatatctaccatcgtacatagttacatttttttgtgtgacaggaacagctaaaatctacgtatttaacaaaaatcctaaagacaatacatttttattaactatagccctcatgatgtacattagatcgtgtggttgtttcttccgtccccgccacgccttcctcctgggatggggattcattccctagcaggtgtcggagaactggcgcccttgcagggtaggtgccccggagcctgaggcgggnactttaanatcagacgcttgggggccggctgggaaaaactggcggaaaatattataactgnactctcaatgccagctgttgtagaagctcctgggacaagccgtggaagtcccctcaggaggcttccgcgatgtcctaggtggctgctccgcccgccacggtcatttccattgactcacacgcgccgcctggaggaggaggctgcgctggacacgccggtggcgcctttgcctgggggagcgcagcctggagctctggcggcagcgctgggagcggggcctcggaggctgggcctggggacccaaggttgggcggggcgcaggaggtgggctcagggttctccagagaatccccatgagctgacccgcagggcggccgggccagtaggcaccgggcccccgcggtgacctgcggacccgaagctggagcagccactgcaaatgctgcgctgaccccaaatgctgtgtcctttaaatgttttaattaagaataattaataggtccgggtgtggaggctcaagccttaatccccagcacctggcgaggccgaggaggga

SEQ ID NO: 39 - DNA, 2331 bp, homo sapiens
  sequence of STAR39
tcactgcaacctccacctcccaggttcaagtgattctcctgcctcggcctcccgagtagctgggactacaggtgcatgacaccgcacctggctagtttttgtatttttagtagagacagggtttcactatgttggccaggttggtctcgaactcctgaccttgtgatccgcccacctcggcctcccaaagtgctgggattacagagtgagccactgcgcctggcctgcaccccttactattatatgctttgcattttcttttagatttgaagaacctcattataaactctagcactaatcttatgtcagttaaatgcatagcaaatatctcctgacgtgggagaatatatatttgcaagtcttcttgtgaacatatgttttcagttctagggagccagacgcctatgagtgaaaagcctagtcatcgtggagaagtgcattcaactttgtaagaaactgccaaacctttattcataatggttgtataaattttacattaccaccaataatgtatgagagttccagttgcttcacatcctcaccagcattttgttttgtctgtcttttttcctttggttattctagtgggcataagatataatagtatcccttgtggtttaatgtaaattccactgaagactaataacatttgcatatttctaattaataagcctttttaagtgacttttcaagtctttgctcatttttattagatatttgccttcttattattgatttgaaagaattatatttatatgcttatattctggttataagccctttgtcattattttccaaaacaatatttggttgtttctgtactactttccttgctcctttgaattgacttggtgccttggccaaaaatcaattgaccacatacatgtgggtgcatctccagactaccacattccgtttatctatttgtctctccttgtgtcaataacactctgtcttgataatggtaagttttgagatcaggttgtgtaagtcctcctaatttttcctgggttttcaatattgctttgctttttaaaaattttgtattttcatttacattttaaaataaacttgttagtgggattttgattggcattgcactgaactcgtggatcaatttggggagattggacattcttatatatggatcccgtggtcatcaactttaagaactctttctcatccattagtaactcaatctaggttcagatgctactcgttttctgctcagtctgtgtctgagccccttatgctcttcattttgtcatccaattaacctcagctttgcatcaatactatttcttgctttggtgcctgttacctctcctctaatcaccaatccacaacttacctccaaattcagggcttgtctcattcttcccaggaggagtgctgctcagtctatctacttagtattataatttctctggcttggtatcaaggcactcccatttccggcttccatgagatgtctcagagggcatgctgcccggtgtagctgcatggtcaagcttcttcatatctcttgcctcatcacttaaactcactattttgtactcctgcttcagctatagggagctactgttagtttcttgaagacatatgctctctctctctctcacatctggacctgagcacatcctgttactgctgcttgaaacaatgtgatccccaggcacacaccattagcttagaagcctcccctgattcttcaaggctggttgagtcccttctctgtgctctcatgacaacagttggcaattcctcgttgcagcacctagcccatgatgctctttggaggcagagactgagtctttctcactattgaatttccagcattcatcacagagcctggcatatataaagccctccatcatatgtattaagtgaatggataaatgaaaaaaagttatatatatgtacatatatgtgtatatatgtatatgtatatatgtgtatatatgtgtgtatatgtgtgtgtatatatgtacatatatatgtatctatgtacatatatgtatatatgtatatatatgtgtgtgtatatgtgtgtgtgtatgtatatatattacaatgaaatactattcagccttaaaaaggcagggaatcctgtcatttaacacaatatggataaacctagaggactctaaaggcaaataccacatgttctcactcacaaaatctaaacaagttgaactcctacaagtagagagtaggatgatggttaccaagggctgggggacgggagaggatggggaaagcatagctgtccatcaaagggtagaaagtttcatttagacaagaggaatcagctttagtgatctatttcac

SEQ ID NO: 40 - DNA, 1071 bp, homo sapiens
  sequence of STAR40
gctgtgattcaaactgtcagcgagataaggcagcagatcaagaaagcactccgggctccagaaggagccttccaggccagctttgagcataagctgctgatgagcagtgagtgtcttgagtagtgttcagggcagcatgttaccattcatgcttgacttctagccagtgtgacgagaggctggagtcaggtctctagagagttgagcagctccagccttagatctcccagtcttatgcggtgtgcccattcgctttgtgtctgcagtcccctggccacacccagtaacagttctgggatctatgggagtagcttccttagtgagctttcccttcaaatactttgcaaccaggtagagaattttggagtgaaggttttgttcttcgtttcttcacaatatggatatgcatcttcttttgaaaatgttaaagtaaattacctctcttttcagatactgtcttcatgcgaacttggtatcctgtttccatcccagccttctataacccagtaacatcttttttgaaaccagtgggtgagaaagacacctggtcaggaacgcggaccacaggacaactcaggctcacccacggcatcagactaaaggcaaacaaggactctgtataaagtaccggtggcatgtgtattagtggagatgcagcctgtgctctgcagacagggagtcacacagacacttttctataatttcttaagtgctttgaatgttcaagtagaaagtctaacattaaatttgattgaacaattgtatattcatggaatattttggaacggaataccaaaaaatggcaatagtggttctttctggatggaagacaaacttttcttgtttaaaataaattttattttatatatttgaggttgaccacatgaccttaaggatacatatagacagtaaactggttactacagtgaagcaaattaacatatctaccatcgtacatagttacatttttttgtgtgacaggaacagctaaaatctacgtatttaacaaaaatcctaaagacaatacatttttattaactatagccctcatgatgtacattagatctctaa

SEQ ID NO: 41 - DNA, 1135 bp, homo sapiens
  sequence of STAR41
tgctcttgttgcccaggctgcagtgcaatggcgctgtctcggctcatcgcaacctccgcctcccagattcaagtgattctcctgcctcaccctcccaagtagctgggattaccagtatgcagcaacacgcccggctaattttgtatttgtaatagagacggggtttcttcatgttggtcaggctggtctcaaattcctgccctcaggtgatctgcccaccttggcctcccaaagtgctgggattacaggcatgagccactgtgcccggcctgggctggggcttttaaggggactggagggtgaggggctggaaaattgggagagttgattggtggggcaagggggatgtaatcatcagggtgtacaaactgcactcttggtttagtcagctcctcgtggggtccttcggagcagctcagtcagtagctccatcagtatacaggacccaaaggaatatctcaaagggaaaacagcatttcctaaggttcaagttgtgatctacggagcagttaggggaactacaatcttgtgacagggtctacatgcttctgaggcaatgagacaccaagcagctacgaggaagcagtcagagagcacgccgacctagtgactgatgctgatgtgctgcgagctgggttcattttcatttctcccctccccctgccctcattaattttgtaaagtttatagggaacatttcacccactctgctgtggatccctgtcacttacggagtctgtcatcttggctgtatgggctgtggcctctgcggtgcccattctcaggaggtgtgagacccatgaggaccggaggtggacaaggctagagaccacacccccccgctccatccaatcatgttttcctgggtgcttggtttctatgcaggctgcatgtccttagtccctgcatgggaacagctcctgtggtgagcaggcccctgaggaaggccttgagcgggaatggagcctaggcttaggctgcctggtaagagctggagggaaccagccgaggcttgtgctacttttttttccagaatgaaatacgtgactgatgttggtgtcctgcagcgccacgtttcccgccacaaccaccggaacgaggatgaggagaacacactctccgtggactgcacacg

SEQ ID NO: 42 - DNA, 735 bp, homo sapiens
  sequence of STAR42
aagggtgagatcactagggagggaggaaggagctataaaagaaagaggtcactcatcacatcttacacactttttaaaaccttggttttttaatgtccgtgttcctcattagcagtaagccctgtggaagcaggagtctttctcattgaccaccatgacaagaccctatttatgaaacataatagacacacaaatgtttatcggatatttattgaaatataggaatttttcccctcacacctcatgaccacattctggtacattgtatgaatgaatataccataattttacctatggctgtatatttaggtcttttcgtgcaggctataaaaatatgtatgggccggtcacagtgacttacgcccgtagtcccagaactttgggaggccgaggcgggtggatcacctgaggtcgggagttcaaaaccagcctgaccaacatggagaaaccccgtctctgctaaaaatacaaaaattaactggacacggtggcgtatgcctgtaatcccagctactcgggaagctgaggcaggagaactgcttgaacccaggaggcggaggttgtggtgagtcgagattgcgccattgcactccagcctgggcaacaagagcgaaattccatctcaaaaaaaagaaaaaagtatgactgtatttagagtagtatgtggatttgaaaaattaataagtgttgccaacttaccttagggtttataccatttatgagggtgtcggtttc

SEQ ID NO: 43 - DNA, 1227 bp, homo sapiens
  sequence of STAR43
caaatagatctacacaaaacaagataatgtctgcccatttttccaaagataatgtggtgaagtgggtagagagaaatgcatccattctccccacccaacctctgctaaattgtccatgtcacagtactgagaccagggggcttattcccagcgggcagaatgtgcaccaagcacctcttgtctcaatttgcagtctaggccctgctatttgatggtgtgaaggcttgcacctggcatggaaggtccgttttgtacttcttgctttagcagttcaaagagcagggagagctgcgagggcctctgcagcttcagatggatgtggtcagcttgttggaggcgccttctgtggtccattatctccagcccccctgcggtgttgctgtttgcttggcttgtctggctctccatgccttgttggctccaaaatgtcatcatgctgcaccccaggaagaatgtgcaggcccatctcttttatgtgctttgggctattttgattccccgttgggtatattccctaggtaagacccagaagacacaggaggtagttgctttgggagagtttggacctatgggtatgaggtaatagacacagtatcttctctttcatttggtgagactgttagctctggccgcggactgaattccacacagctcacttgggaaaactttattccaaaacatagtcacattgaacattgtggagaatgagggacagagaagaggccctagatttgtacatctgggtgttatgtctataaatagaatgctttggtggtcaactagacttgttcatgttgacatttagtcttgccttttcggtggtgatttaaaaattatgtatatcttgtttggaatatagtggagctatggtgtggcattttcatctggctttttgtttagctcagcccgtcctgttatgggcagccttgaagctcagtagctaatgaagaggtatcctcactccctccagagagcggtcccctcacggctcattgagagtttgtcagcaccttgaaatgagtttaaacttgtttatttttaaaacattcttggttatgaatgtgcctatattgaattactgaacaaccttatggttgtgaagaattgatttggtgctaaggtgtataaatttcaggaccagtgtctctgaagagttcatttagcatgaagtcagcctgtggcaggttgggtggagccagggaacaatggagaagctttcatgggtgg

SEQ ID NO: 44 - DNA, 1586 bp, homo sapiens
  sequence of STAR44
tgagttggggtcctaagccagaagttaactatgctttcatatattcttgcaagtagaagtacagtgttggtgtaaattccccttagatggatagctaagcccagaggaaataatggtaattggaaccatatgaccgtatgcaattcatgtgcatatttatatcaagaaaagaacattataggtcgggtgagaccctattttgttctgacaatgtcatctgtatttacatgtctgtttcgggagtttggatgtcaagggattctgtgctggattgtaaagcatgtgcttctgcttgatgtagctactcaattttgtattcttgactaataaagtcataaacataattcaacctctgtgtgcgtgctctccttccattaatttatactttagcaaaaagtattgaatgtgtgtgttatgtaacaatttcctataaattatattaaatgatttattagctttattcaataaagttttaagtgttttcttctatgactacattatttgttaacaagaaatttctttaactgaaaacttcaaggaagactatctgggtaactctttcaaaaagaattgtccctgtattttgggattgaatatattaatttcttgtactgttttaacagcacataattttacaagacaagccactttttcaaagcctgcttctcctcccattttccctatctctgtgattgacacctccaacccctgtagcctgcctctgctctctcttaaccagtcctactgatactacttcctaagtatttttcagccctgtccttcctctccatcatgatggattcacttccagttgaaatccttatggtaccctccctggattatggcagtaatcagagagctggtctccttaactcaggattcacttcttctcatctgttgttcacagtgacatcagaaagatattttaaaatgatgaactagaattaattatataaaacacacatacacacataaataatacttaaatttttcaatgatgttccaattatgtaaaatataatataggaggcactttatgttctggcctcaatctttcaattcaaacttatctcctgccactatctcctttgaacattgtattccagctactttagaataataataatacataatattcatagagcccttcctgggttcctatcaccgtacaaaatacttcacatataacatttaatctttgacaactttattaggcatgcacaattattatctatctatatatctatatctatatatataaaatctatattttatagataagaaaatagagggtaaaaacttgccaaaattacaaagcttagaagtgtagcagttgggatttgaatctaggcatcctgcctctatagtctacagtggctttcttgtgccaaaagccttgcagttccctagacttaacatttctcaaaatctgtgtctttcacatgctcttccaattgtctggaaaatctttcccaacctcagtctaactgtggtactcatgttcaccccacaagaattgactccatctgtcccctctccatgaaaatttctttgaatctcagcactttgggaggctgaggcaggtg

SEQ ID NO: 45 - DNA, 1981 bp, homo sapiens
  sequence of STAR45
cacgccccagcgtgccctggactactgctccgcaggactcctgttctgctgcaccctggactacggcaccagaggacccagctcccgccggcctgagctatggcaccagaggacccagctcccggcagcctggactatggcaccagaggacccagccccccgcttcctgggctaaggcacagtaggaccctgcctcatcgtgtactcctgctcaggaggaccctcgcagggcggcgcactggactaagctactgaaggagccccacccctgcctaaccctggactaaggcactggagaactcttgctccgcagagccacggactcttgcacaagagaacctcagcccagccgtgccctggactgtggcacagtagggcccacaccacgccatggactcctgtattggaggaagagtagtgataaatgtccaggtttacaacttgaaaagtagcaatcaatgtgccacaatagatggatgtgatgtaaaattataaatgatgaaaacattatgtgtaattgcctagccagaacagttacacaagacaaagacgtaaaagaaatccacatagggaaggaagaggtaagattgtttctgttttttgaaaatataatcttaagatagagaaaatcttaaagattccaccaaaataaatggttatagctgatgaagaaattcaataaagttaatagttacaaaatcaacatacaaatatcattattgtttctattaactaatgacaaactattacctgaaaaataaaggcaattcaatttataatagaatcaaaacagatatataaatatataaaagacaggagtaaatttaatcaaaaccataaaagatttacatactgaaaactatagcacattgatgaaaaaaattaaaatggcataaataaatggagaaacatccttcattgatggattcaaaaattagtattgtaaaagtgtcaatgctacccaaagcaatctacagattaaatgcaaccactatcaaattccaatgtcattcttcacagaaatagaaaaattactgctaaaatttgtatggaaccacaaaagacctggaccaaccaaagcaatcttgaacaaaaagaacaaagctggaggcatcagactacctgactccaaactctattacaaagctataggaattaaaacagcatagcaatggcataaaaacagacatgtaaaacagtacaaagggatatagaacctgtaaataaatccgtgtgtctgtggtcaattgattttttgataaaataactaaaaatacacagtgaagaaagaaaattattttcaataaatggtgtagacaaaactgactatccacatacagaagaataaaatttgacttttattttgctctttatacaagcatcaaatcaaaattaaagtttaaatgtaaaactactacaaggaaatatagaaggagactgtatgacattggcctgagctatgattttctgtagattattccaaaaggcaacaaaagcaaaacacacaaatgagactgcataaaacttaaaacttttccacaggaaaagaagcaatgatagaattaagagaacccacaaatgggataatatttttaaaccatacatcaggtaaggggctcatataataatatataagcaactcaacctactcaaaaataagaaaaaaactatgcttattaaaaaataagcaaagaatcagaatagacatttcctacatcatacaaaaggccaaccaggtacatgaaaaaatcataaacattcctaattatcagagaagtgcaaatcaatgccacaatgagatatcacctcacacattttactagggctattataaaaaaagatggaagataagtgttggtgaggatgtggagaaaaagaaaccctgtacactgttggtaggaatggaaattagtacagccatcttggaaaacagtacgaagctttctcaagaaattataaatttatttaccctatgatccat

SEQ ID NO: 46 - DNA, 1859 bp, homo sapiens
  sequence of STAR46
attgtttttctcgcccttctgcattttctgcaaattctgttgaatcattgcagttacttaggtttgcttcgtctcccccattacaaactacttactgggtttttcaaccctagttccctcatttttatgatttatgctcatttctttgtacacttcgtcttgctccatctcccaactcatggcccctggctttggattattgttttggtcttttattttttgtcttcttctacctcaacacttatcttcctctcccagtctccggtaccctatcaccaaggttgtcattaacctttcatattattcctcattatccatgtattcatttgcaaataagcgtatattaacaaaatcacaggtttatggagatataattcacataccttaaaattcaggcttttaaagtgtacctttcatgtggtttttggtatattcacaaagttatgcattgatcaccaccatctgattccataacatgttcaatacctcaaaaagaagtctgtactcattagtagtcatttcacattcaccactccctctggctctgggcagtcactgatctttgtgtctctatggatttgcctagtctaggtatttttatgtaaatggcatcatacaacatgtgaccttttgtttggcttttttcatttagcaaaatgttatcaaggtctgtccctgttgtagcatgtattagcacttcatttcttatatgctgaatgatatactttatttgtccatcagttgttcatgctttatttgtccatcagttgatgaacatttgcgtttttgccactttgggctattaagaataatgctactgtgaacaagtgtgtacaagttcctctacaaatttttgtgtggacatatcctttcagttctctcaggtgtatatctgggaattgaattgctgggtcgtgtagtagctatgttaaacactttgagaaactgctataatgttctccagagctgtaccattttaaattctgtgtatgaggattccacgttctccacttcctcaccagtgtatggatttgggggtatactttttaaaaagtgggattaggctgggcacagtggctcacacctgtaatcccaacacttcaggaagctgaggtgggaggatcacttgagcctagtagtttgagaccagcctgggcaacatagggagaccctgtctctacaaaaaataatttaaaataaattagctgggcgttgtggcacacacctgtagtcccagctacatgggaggctgaggtggaaggattccctgagcccagaagtttgaggttgcagtgagccatgatggcagcactatactgtagcctgggtgtcagagcaagactccgtttcagggaagaaaaaaaaaagtgggatgatatttttgacacttttcttcttgttttcttaatttcatacttctggaaattccattaaattagctggtaccactctaactcattgtgtttcatggctgcatagtaatattgcataatataaatataccattcattcatcaaagttagcagatattgactgttaggtgccaggcactgctctaagcgttaaagaaaaacacacaaaaacttttgcattcttagagtttattttccaatggagggggtggagggaggtaagaatttaggaaataaattaattacatatatagcatagggtttcaccagtgagtgcagcttgaatcgttggcagctttcttagtagtataaatacagtactaaagatgaaattactctaaatggtgttacttaaattactggaataggtattactattagtcactttgcaggtgaaagtggaaacaccatcgtaaaatgtaaaataggaaacagctggttaatgtt

SEQ ID NO: 47 - DNA, 1082 bp, homo sapiens
  sequence of STAR47
atcattagtcattagggaaatgcaaatgaaaaacacaagcagccaccaatatacacctactaggatgatttaaaggaaaataagtgtgaagaaggacgtaaagaaattgtaaccctgatacattgatggtagaaatggataaagttgcagccactgtgaaaaacagtctgcagtggctcagaaggttaaatatagaacccctgttggacccaggaactctactcttaggcaccccaaagaatagagaacagaaatcaaacagatgtttgtatactaatgtttgtagcatcacttttcacaggagccaaaaggtggaaataatccaaccatcagtgaacaaatgaatgtaataaaagcaaggtggtctgcatgcaatgctacatcatccatctgtaaaaaacgaacatcattttgatagatgatacaacatgggtggacattgagaacattatgcttagtgaaataagccagacacaaaaggaatatattgtataattgtaattacatgaagtgcctagaatagtcaaattcatacaagagaaagtgggataggaatcaccatgggctggaaatagggggaaggtgctatactgcttattgtggacaaggtttcgtaagaaatcatcaaaattgtgggtgtagatagtggtgttggttatgcaaccctgtgaatatattgaatgccatggagtgcacactttggttaaaaggttcaaatgataaatattgtgttatatatatttccccacgatagaaaacacgcacagccaagcccacatgccagtcttgttagctgccttcctttaccttcaagagtgggctgaagcttgtccaatctttcaaggttgctgaagactgtatgatggaagtcatctgcattgggaaagaaattaatggagagaggagaaaacttgagaatccacactactcaccctgcagggccaagaactctgtctcccatgctttgctgtcctgtctcagtatttcctgtgaccacctcctttttcaactgaagactttgtacctgaaggggttcccaggtttttcacctcggcccttgtcaggactgatcctctcaacta

SEQ ID NO: 48 - DNA, 1242 bp, homo sapiens
  sequence of STAR48
atcatgtatttgttttctgaattaattcttagatacattaatgttttatgttaccatgaatgtgatattataatataatatttttaattggttgctactgtttataagaatttcattttctgtttactttgccttcatatctgaaaaccttgctgatttgattagtgcatccacaaattttcttggattttctatgggtaattacaaatctccacacaatgaggttgcagtgagccaagatcacaccactgtactccagcctgggcgacagagtgagacaccatctcacaaaaacacataaacaaacaaacagaaactccacacaatgacaacgtatgtgctttctttttttcttcctctttctataatatttctttgtcctatcttaactgaactggccagaaaccccaggacaatgataaatacgagcagtgtcaacagacatctcattccctttcctagcttttataaaaataacgattatgcttcaacattacatatggtggtgtcgatggttttgttatagataagcttatcaggttaagaaatttgtctgcgtttcctagtttggtataaagattttaatataaatgaatgttgtattttatcatcttatttttttcctacatctgctaaggtaatcctgtgttttccccttttcaatctcctaatgtggtgaatgacattaaaataccttctattgttaaaatattcttgcaacgctgtatagaaccaatgcctttattctgtattgctgatggatttttgaaaaatatgtaggtggacttagttttctaaggggaatagaatttctaatatatttaaaatattttgcatgtatgttctgaaggacattggtgtgtcatttctataccatctggctactagaggagccgactgaaagtcacactgccggaggaggggagaggtgctcttccgtttctggtgtctgtagccatctccagtggtagctgcagtgataataatgctgcagtgccgacagttctggaaggagcaacaacagtgatttcagcagcagcagtattgcgggatccccacgatggagcaagggaaataattctggaagcaatgacaatatcagctgtggctatagcagctgagatgtgagttctcacggtggcagcttcaaggacagtagtgatggtccaatggcgcccagacctagaaatgcacatttcctcagcaccggctccagatgctgagcttggacagctgacgcct

SEQ ID NO: 49 - DNA, 1015 bp, homo sapiens
  sequence of STAR49
aaaccagaaacccaaaacaatgggagtgacatgctaaaaccagaaacccaaaacaatgggagggtcctgctaaaccagaaacccaaaacaatgggagtgaagtgctaaaaccagaaacccaaaacaatgggagtgtcctgctacaccagaaacccaaaacgatgggagtgacgtgataaaaccagacacccaaaacaatgggagtgacgtgctaaaccagaaacccaaaacaatgggagtgacgtgctaaaacctggaaacctaaaacaatgcgagtgaggtgctaacaccagaatccataacaatgtgagtgacgtgctaaaccagaacccaaaacaatgggagtgacgtgctaaaacaggaacccaaaacaatgagagtgacgtgctaaaccagaaacccaaaacaatgggaatgacgtgctaaaaccggaacccaaaacaatgggagtgatgtgctaaaccagaaacccaaaacaatgggaatgacatgctaaaactggaacccaaaacaatggtaactaagagtgatgctaaggccctacattttggtcacactctcaactaagtgagaacttgactgaaaaggaggatttttttttctaagacagagttttggtctgtcccccagagtggagtgcagtggcatgatctcggctcactgcaagctctgcctcccgggttcaggccattctcctgcctcagcctcctgagtagctgggaatacaggcacccgccaccacacttggctaattttttgtatttttagtagagatggggtttcaccatattagcaaggatggtctcaatctcctgacctcgtgatctgcccacctcaggctcccaaagtgctgggattacaggtgtgagccaccacacccagcaaaaaggaggaatttttaaagcaaaattatgggaggccattgttttgaactaagctcatgcaataggtcccaacagaccaaaccaaaccaaaccaaaatggagtcactcatgctaaatgtagcataatcaaa

SEQ ID NO: 50 - DNA, 2355 bp, homo sapiens
  sequence of STAR50
caaccatcgttccgcaagagcggcttgtttattaaacatgaaatgagggaaaagcctagtagctccattggattgggaagaatggcaaagagagacaggcgtcattttctagaaagcaatcttcacacctgttggtcctcacccattgaatgtcctcacccaatctccaacacagaaatgagtgactgtgtgtgcacatgcgtgtgcatgtgtgaaagtatgagtgtgaatgtgtctatatgggaacatatatgtgattgtatgtgtgtaactatgtgtgactggcagcgtggggagtgctggttggagtgtggtgtgatgtgagtatgcatgagtggctgtgtgtatgactgtggcgggaggcggaaggggagaagcagcaggctcaggtgtcgccagagaggctgggaggaaactataaacctgggcaatttcctcctcatcagcgagcctttcttgggcaataggggcagagctcaaagttcacagagatagtgcctgggaggcatgaggcaaggcggaagtactgcgaggaggggcagagggtctgacacttgaggggttctaatgggaaaggaaagacccacactgaattccacttagccccagaccctgggcccagcggtgccggcttccaaccataccaaccatttccaagtgttgccggcagaagttaacctctcttagcctcagtttccccacctgtaaaatggcagaagtaaccaagcttaccttcccggcagtgtgtgaggatgaaaagagctatgtacgtgatgcacttagaagaaggtctagggtgtgagtggtactcgtctggtgggtgtggagaagacattctaggcaatgaggactggggagagcctggcccatggcttccactcagcaaggtcagtctcttgtcctctgcactcccagccttccagagaggaccttcccaaccagcactccccacgctgccagtcacacatagttacacacatacaatcacatatatgttcccatatagacacattcacactcataccttcacacatgcacacgcatgtgcacacacagtcactcatttctgtgttggagattgggtgaggacattcaatgggtgaggaccaacaggtgtgaagattgctttctagaaaatgactcctgtctctctttgccattcttcccaatccgatggagctactaggcttttccctcatttcatgtttaataaaccttcccaatggcgaaatgggctttctcaagaagtggtgagtgtcccatccctgcggtggggacaggggtggcagcggacaagcctgcctggagggaactgtcaggctgattcccagtccaactccagcttccaacacctcatcctccaggcagtcttcattcttggctctaatttcgctcttgttttcttttttatttttatcgagaactgggtggagagcttttggtgtcattggggattgctttgaaacccttctctgcctcacactgggagctggcttgagtcaactggtctccatggaatttctttttttagtgtgtaaacagctaagttttaggcagctgttgtgccgtccagggtggaaagcagcctgttgatgtggaactgcttggctcagatttcttgggcaaacagatgccgtgtctctcaactcaccaattaagaagcccagaaaatgtggcttggagaccacatgtctggttatgtctagtaattcagatggcttcacctgggaagccctttctgaatgtcaaagccatgagataaaggacatatatatagtagctagggtggtccacttcttaggggccatctccggaggtggtgagcactaagtgccaggaagagaggaaactctgttttggagccaaagcataaaaaaaccttagccacaaaccactgaacatttgttttgtgcaggttctgagtccagggagggcttctgaggagaggggcagctggagctggtaggagttatgtgagatggagcaagggccctttaagaggtgggagcagcatgagcaaaggcagagaggtggtaatgtataaggtatgtcatgggaaagagtttggctggaacagagtttacagaatagaaaaattcaacactattaattgagcctctactacgtgctcgacattgttctagtcactgagataggtttggtatacaaaacaaaatccatcctctatggacattttagtgactaacaacaatataaataataaaagtgaacaaaagctcaaaacatgccaggcactattatttatttatttatttatttatttatttattttttgaaacagagtctcgctctgttgcccaggctggagtgtagtggtgcgatctcggctcactg

SEQ ID NO: 51 - DNA, 2289 bp, homo sapiens
  sequence of STAR51
tcacaggtgacaccaatcccctgaccacgctttgagaagcactgtactagattgactttctaatgtcagtcttcattttctagctctgttacagccatggtctccatattatctagtacaacacacatacaaatatgtgtgatacagtatgaatataatataaaaatatgtgttataatataaatataatattaaaatatgtctttatactagataataatacttaataacgttgagtgtttaactgctctaagcactttacctgcaggaaacagttttttttttattttggtgaaatacaactaacataaatttatttacaattttaagcatttttaagtgtatagtttagtggagttaatatattcaaaatgttgtgcagccgtcaccatcatcagtcttcataactcttttcatattgtaaaattaaaagtttatgctcatttaaaaatgactcccaatttcccccctcctcaacctctggaaactaccattctattttctgcctccgtagttttgcccactctaagtacctcacataagtggaatttgtcttatttgcctgtttgtgaccggctgatttcatttagtataatgtcctcaagttttattcacgttatatagcatatgtcataattttcttcacttttaagcttgagtaatatttcatcgtatgtatctcacattttgcttatccattcatctctcagtggacacttgagttgcttctacattttagctgttgtgaatactgctgctatgaacatgggtgtataaatatctcaagacctttttatcagttttttaaaatatatactcagtagtagtttagctggattatatggtaattttatttttaatttttgaggaactgtcctacccttttattcaatagtagctataccaattgacaattggcattcctaccaacagggcataagggttctcaattctccacatattccctgatacttgttattttcaggtgttttttttttttttttttttttatgggagccatgttaatgggtgtaaggtgatatttcattatagttttgatttgcatttccctaatgattagtgatgttaagcatctcttcatgtgcctattggccatttgtatatcttctttaaaaatatatatatactcattcctttgcccatttttgaattatgtttattttttgttattgagtttcaatacttttctatataacctaggtattaatcctttatcagacttaagatttgcaaatattctctttcattccacaggttgctaattctctctgttggtaatatcttttgatgctgttgtgtccagaattgattcattcctgtgggttcttggtctcactgacttcaagaataaagctgcggaccctagtggtgagtgttacacttcttatagatggtgtttccggagtttgttccttcagatgtgtccagagtttcttccttccaatgggttcatggtcttgctgacttcaggaatgaagccgcagaccttcgcagtgaggtttacagctcttaaaggtggcgtgtccagagttgtttgttccccctggtgggttcgtggtcttgctgacttcaggaatgaagccgcagaccctcgcagtgagtgttacagctcataaaggtagtgcggacacagagtgagctgcagcaagatttactgtgaagagcaaaagaacaaagcttccacagcatagaaggacaccccagcgggttcctgctgctggctcaggtggccagttattattcccttatttgccctgcccacatcctgctgattggtccattttacagagtactgattggtccattttacagagtgctgattggtgcatttacaatcctttagctagacacagagtgctgattgctgcattcttacagagtgctgattggtgcatttacagtcctttagctagatacagaacgctgattgctgcgttttttacagagtgctgattggtgcatttacaatcctttagctagacacagtgctgattggtgggtttttacagagtgctgattggtgcgtctttacagagtgctgattggtgcatttacaatcctttagctagacacagagtgctgattggtgcgtttataatcctctagctagacagaaaagttttccaagtccccacctgaccgagaagccccactggcttcacctctcactgttatactttggacatttgtccccccaaaatctcatgttgaaatgtaacccctaatgttggaactgaggccagactggatgtggctgggccatgggga

SEQ ID NO: 52 - DNA, 1184 bp, homo sapiens
  sequence of STAR52
cttatgccatctggcggtgccatgtggaacttcgctgaagaagctaaatttactgaccatctgtgcctagagcgggtttctccaaggaaaggctctgtaaatctcgtccttttgaaatctaggggaaaacagcctccttcactgaggattaatttaaagaaagggggaaataggaaaattccatgcgttggaagtccatttagatttctacatgaaccatcatatatgtgcactacataattcttatttttttatttttaaaaaagggataatttatattccagtgacaagtttgggaaaggccaaggcaagcaattgagttgaacattatgtagcgtttatatagaccttgcagacgtctgtgcaatatccaccactgaacacgtgaggtcgtactcaagtctctctggcccctggtaatgtgactcccttcctttatttgcatgaatcgcctggattgggtgtcaggtttttaaaacgtcaaggtttacgcctattgttgtcaaccaatcagcatcctactttgacgtgattggcttctactgtaggtgtcaatcatccaaaatttgcatactactcctcaggccgccgggagcctgtcagtcggctgtggcagctggaagagaaggaatcggacggagaagaatgaaaaatcactttgctttcgcaaagcgaaagaaaagtattcttttcctcattatttttaaataaatttgattgtatatttacctaataaaataaacattcaattaaacaaaaataagcaactatcaaagatttgtttactaattttcgtaatgtttactgtttcaataagtagccaaaggaatattaaaacacaaaaatatgaatgctgataattttatgtcataaagaccattttaaaactaaaagtgaacatggggtttctaaataaaattaccgtggtagcgtaaaaacactgctttcaatacttgggcatgctgaaagtgctgcatcctaagataaaaaatacaccaagggggggatttcaaagaacattattttgcttttaataatcctgtatttctgtcactttgccctttttatttatttaccgtgaactcacagacagaatattacttggagtttctgaaatacttgtgtttgtacatttctcatcttacacgtacccacacaccccaaaataaaaaaacaaagaagag

SEQ ID NO: 53 - DNA, 1431 bp, homo sapiens
  sequence of STAR53
ccctgaggaagatgacgagtaactccgtaagagaaccttccactcatcccccacatccctgcagacgtgctattctgttatgatactggtatcccatctgtcacttgctccccaaatcattcccttcttacaattttctactgtacagcattgaggctgaacgatgagagatttcccatgctctttctactccctgccctgtatatatccggggatcctccctacccaggatgctgtggggtcccaaaccccaagtaagccctgatatgcgggccacacctttctctagcctaggaattgataacccaggcgaggaagtcactgtggcatgaacagatggttcacttcgaggaaccgtggaaggcgtgtgcaggtcctgagatagggcagaatcggagtgtgcagggtctgcaggtcaggaggagttgagattgcgttgccacgtggtgggaactcactgccacttatttccttctctcttcttgcctcagcctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttccccagttgtttgctcgtgccattattgtgcacacagctctgtgcacgtgtgtgcatatttctttaggaaagattcttagaagtggaattgctgtgtcaaaggagtcatttattcaacaaaacactaatgagtgcgtcctcgtgctgagcgctgttctaggtgctggagcgacgtcagggaacaaggcagacaggagttcctgacccccgttctagaggaggatgtttccagttgttgggttttgtttgtttgtttcttctagagatggtggtcttgctctgtccaggctagagtgcagtggcatgatcatagc

SEQ ID NO: 54 - DNA, 975 bp, homo sapiens
  sequence of STAR54
ccataaaagtgtttctaaactgcagaaaaatccccctacagtcttacagttcaagaattttcagcatgaaatgcctggtagattacctgactttttttgccaaaaataaggcacagcagctctctcctgactctgactttctatagtccttactgaattatagtccttactgaattcattcttcagtgttgcagtctgaaggacacccacattttctctttgtctttgtcaattctttgtgttgtaagggcaggatgtttaaaagttgaagtcattgacttgcaaaatgagaaatttcagagggcattttgttctctagaccatgtagcttagagcagtgttcacactgaggttgctgctaatgtttctgcagttcttaccaatagtatcatttacccagcaacaggatatgatagaggacttcgaaaaccccagaaaatgttttgccatatatccaaagccctttgggaaatggaaaggaattgcgggctcccatttttatatatggatagatagagaccaagaaagaccaaggcaactccatgtgctttacattaataaagtacaaaatgttaacatgtaggaagtctaggcgaagtttatgtgagaattctttacactaattttgcaacattttaatgcaagtctgaaattatgtcaaaataagtaaaaatttttacaagttaagcagagaataacaatgattagtcagagaaataagtagcaaaatcttcttctcagtattgacttggttgcttttcaatctctgaggacacagcagtcttcgcttccaaatccacaagtcacatcagtgaggagactcagctgagactttggctaatgttggggggtccctcctgtgtctccccaggcgcagtgagcctgcaggccgacctcactcgtggcacacaactaaatctggggagaagcaacccgatgccagcatgatgcagatatctcagggtatgatcggcc

SEQ ID NO: 55 - DNA, 501 bp, homo sapiens
  sequence of STAR55
cctgaactcatgatccgcccacctcagcctcctgaagtgctgggattacaggtgtgagccaccacacccagccgcaacacactcttgagcaaccaatgtgtcataaaagaaataaaatggaaatcagaaagtatcttgagacagacaaaaatggaaacacaacataccaaaatttatgggacacagcaaaagcagttttaggagggaagtttatagtgatgaatacctacctcaaaatcattagcctgattggatgacactacagtgtataaatgaattgaaaaccacattgtgccccatacatatatacaatttttatttgttaattaaaaataaaataaaactttaaaaaagaagaaagagctcaaataaacaacctaactttatacctcaaggaaatagaagagccagctaagcccaaagttgacagaaggaaaaaaatattggcagaaagaaatgaaacagagactagaaagacaattgaagagatcagcaaaacta

SEQ ID NO: 56 - DNA, 741 bp, homo sapiens
  sequence of STAR56
acacaggaaaagatcgcaattgttcagcagagctttgaaccggggatgacggtctccctcgttgcccggcaacatggtgtagcagccagccagttatttctctggcgtaagcaataccaggaaggaagtcttactgctgtcgccgccggagaacaggttgttcctgcctctgaacttgctgccgccatgaagcagattaaagaactccagcgcctgctcggcaagaaaacgatggaaaatgaactcctcaaagaagccgttgaatatggacgggcaaaaaagtggatagcgcacgcgcccttattgcccggggatggggagtaagcttagtcagccgttgtctccgggtgtcgcgtgcgcagttgcacgtcattctcagacgaaccgatgactggatggatggccgccgcagtcgtcacactgatgatacggatgtgcttctccgtatacaccatgttatcggagagctgccaacgtatggttatcgtcgggtatgggcgctgcttcgcagacaggcagaacttgatggtatgcctgcgatcaatgccaaacgtgtttaccggatcatgcgccagaatgcgctgttgcttgagcgaaaacctgctgtaccgccatcgaaacgggcacatacaggcagagtggccgtgaaagaaagcaatcagcgatggtgctctgacgggttcgagttctgctgtgataacggagagagactgcgtgtcacgttcgcgctggactgctgtg

SEQ ID NO: 57 - DNA, 1365 bp, homo sapiens
  sequence of STAR57
tccttctgtaaataggcaaaatgtattttagtttccaccacacatgttcttttctgtagggcttgtatgttggaaattttatccaattattcaattaacactataccaacaatctgctaattctggagatgtggcagtgaataaaaaagttatagtttctgattttgtggagcttggactttaatgatggacaaaacaacacattcttaaatatatatttcatcaaaattatagtgggtgaattatttatatgtgcatttacatgtgtatgtatacataaatgggcggttactggctgcactgagaatgtacacgtggcgcgaacgaggctgggcggtcagagaaggcctcccaaggaggtggctttgaagctgagtggtgcttccacgtgaaaaggctggaaagggcattccaagaaaaggctgaggccagcgggaaagaggttccagtgcgctctgggaacggaaagcgcacctgcctgaaacgaaaatgagtgtgctgaaataggacgctagaaagggaggcagaggctggcaaaagcgaccgaggaggagctcaaaggagcgagcggggaaggccgctgtggagcctggaggaagcacttcggaagcgcttctgagcgggtaaggccgctgggagcatgaactgctgagcaggtgtgtccagaattcgtgggttcttggtctcactgacttcaagaatgaagagggaccgcggaccctcgcggtgagtgttacagctcttaaggtggcgcgtctggagtttgttccttctgatgttcggatgtgttcagagtttcttccttctggtgggttcgtggtctcgctggctcaggagtgaagctgcagaccttcgcggtgagtgttacagctcataaaagcagggtggactcaaagagtgagcagcagcaagatttattgcaaagaatgaaagaacaaagcttccacactgtggaaggggaccccagcgggttgccactgctggctccgcagcctgcttttattctcttatctggccccacccacatcctgctgattggtagagccgaatggtctgttttgacggcgctgattggtgcgtttacaatccctgcgctagatacaaaggttctccacgtccccaccagattagctagatagagtctccacacaaaggttctccaaggccccaccagagtagctagatacagagtgttgattggtgcattcacaaaccctgagctagacacagggtgatgactggtgtgtttacaaaccttgcggtagatacagagtatcaattggcgtatttacaatcactgagctaggcataaaggttctccaggtccccaccagactcaggagcccagctggcttcacccagtgg

SEQ ID NO: 58 - DNA, 1401 bp, homo sapiens
  sequence of STAR58
aagtttaccttagccctaaattatttcattgtgattggcattttaggaaatatgtattaaggaatgtctcttaggagataaggataacatatgtctaagaaaattatattgaaatattattacatgaactaaaatgttagaactgaaaaaaaattattgtaactccttccagcgtaggcaggagtatctagataccaactttaacaactcaactttaacaacttcgaaccaaccagatggctaggagattcacctatttagcatgatatcttttattgataaaaaaatataaaacttccattaaatttttaagctactacaatcctattaaattttaacttaccagtgttctcaatgctacataatttaaaatcattgaaatcttctgattttaactcctcagtcttgaaatctacttatttttagttacatatatatccaatctactgccgctagtagaagaagcttggaatttgagaaaaaaatcagacgttttgtatattctcatattcactaatttattttttaaatgagtttctgcaatgcatcaagcagtggcaaaacaggagaaaaattaaaattggttgaaaagatatgtgtgccaaacaatcccttgaaatttgatgaagtgactaatcctgagttattgtttcaaatgtgtacctgtttatacaagggtatcacctttgaaatctcaacattaaatgaaattttataagcaatttgttgtaacatgattattataaaattctgatataacattttttattacctgtttagagtttaaagagagaaaaggagttaagaataattacattttcattagcattgtccgggtgcaaaaacttctaacactatcttcaaatctttttctccattgccttctgaacatacccacttgggtatctcattagcactgcaaattcaacattttcgattgctaatttttctccctaaatatttatttgttttctcagctttagccaatgtttcactattgaccatttgctcaagtatagtgacgcttcaatgaccttcagagagctgtttcagtccttcctggactacttgcatgcttccaacaaaatgaagcactcttgatgtcagtcactcaaataaatggaaatgggcccatttactaggaatgttaacagaataaaaagatagacgtgacaccagttgcttcagtccatctccatttacttgcttaaggcctggccatatttctcacagttgatatggcgcagggcacatgtttaaatggctgttcttgtaggatggtttgactgttggattcctcatcttccctctccttaggaaggaaggttacagtagtactgttggctcctggaatatagattcataaagaactaatggagtatcatctcccactgctcttgt

SEQ ID NO: 59 - DNA, 866 bp, homo sapiens
  sequence of STAR59
gagatcacgccactgcactccagcctgggggacagagcaagactccatctcagaaacaaacaaacacacaaagccagtcaaggtgtttaattcgacggtgtcaggctcaggtctcttgacaggatacatccagcacccgggggaaacgtcgatgggtggggtggaatctattttgtggcctcaagggagggtttgagaggtagtcccgcaagcggtgatggcctaaggaagcccctccgcccaagaagcgatattcatttctagcctgtagccacccaagagggagaatcgggctcgccacagaccccacaacccccaacccaccccacccccacccctcccacctcgtgaaatgggctctcgctccgtcaggctctagtcacaccgtgtggttttggaacctccagcgtgtgtgcgtgggttgcgtggtggggtggggccggctgtggacagaggaggggataaagcggcggtgtcccgcgggtgcccgggacgtggggcgtggggcgtgggtggggtggccagagccttgggaactcgtcgcctgtcgggacgtctcccctcctggtcccctctctgacctacgctccacatcttcgccgttcagtggggaccttgtgggtggaagtcaccatccctttggactttagccgacgaaggccgggctcccaagagtctccccggaggcggggccttgggcaggctcacaaggatgctgacggtgacggttggtgacggtgatgtacttcggaggcctcgggccaatgcagaggtatccatttgacctcggtgggacaggtcagctttgcggagtcccgtgcgtccttccagagactcatccagcgctagcaagcatggtcccgagg

SEQ ID NO: 60 - DNA, 2067 bp, homo sapiens
  sequence of STAR60
  misc_feature (92)..(1777): All "N" on various positions stand for any nucleotide
agcagtgcagaactggggaagaagaagagtccctacaccacttaatactcaaaagtactcgcaaaaaataacacccctcaccaggtggcatnattactctccttcattgagaaaattaggaaactggacttcgtagaagctaattgctttatccagagccacctgcatacaaacctgcagcgccacctgcatacaaacctgtcagccgaccccaaagccctcagtcgcaccaagcctctgctgcacaccctcgtgccttcacactggccgttccccaagcctggggcatactncccagctctgagaaatgtattcatccttcaaagccctgctcatgtgtcctnntcaacaggaaaatctcccatgagatgctctgctatccccatctctcctgccccatagcttaggcanacttctgtggtggtgagtcctgggctgtgctgtgatgtgttcgcctgcnatgtntgttcttccccacaatgatgggcccctgaattctctatctctagcacctgtgctcagtaaaggcttgggaaaccaggctcaaagcctggcccagatgccaccttttccagggtgcttccgggggccaccaaccagagtgcagccttctcctccaccaggaactcttgcagccccacccctgagcacctgcaccccattacccatctttgtttctccgtgtgatcgtattattacagaattatatactgtattcttaatacagtatataattgtataattattcttaatacagtatataattatacaaatacaaaatatgtgttaatggaccgtttatgttactggtaaagctttaagtcaacagtgggacattagttaggtttttggcgaagtcaaaagttatatgtgcattttcaacttcttgaggggtcggtacntctnacccccatgttgttcaanggtcaactgtctacacatatcatagctaattcactacagaaatgttagcttgtgtcactagtatctccccttctcataagcttaatacacataccttgagagagctcttggccatctctactaatgactgaagtttttatttattatagatgtcataataggcataaaactacattacatcattcgagtgccaattttgccaccttgaccctcttttgcaaaacaccaacgtcagtacacatatgaagaggaaactgcccgagaactgaagttcctgagaccaggagctgcaggcgttagatagaatatggtgacgagagttacgaggatgacgagagtaaatacttcatactcagtacgtgccaagcactgctataagcgctctgtatgtgtgaagtcatttaatcctcacagcatcccacggtgtaattattttcattatccccatgagggaacagaaactcagaacggttcaacacatatgcgagaagtcgcagccggtcagtgagagagcaggttcccgtccaagcagtcagaccccgagtgcacactctcgacccctgtccagcagactcactcgtcataaggcggggagtgntctgtttcagccagatgctttatgcatctcagagtacccaaaccatgaaagaatgaggcagtattcangagcagatggngctgggcagtaaggctgggcttcagaatagctggaaagctcaagtnatgggacctgcaagaaaaatccattgtttngataaatagccaaagtccctaggctgtaaggggaaggtgtgccaggtgcaagtggagctctaatgtaaaatcgcacctgagtctcctggtcttatgagtnctgggtgtaccccagtgaaaggtcctgctgccaccaagtgggccatggttcagctgtgtaagtgctgagcggcagccggaccgcttcctctaacttcacctccaaaggcacagtgcacctggttcctccagcactcagctgcgaggcccctagccagggtcccggcccccggcccccggcagctgctccagcttccttccccacagcattcaggatggtctgcgttcatgtagacctttgttttcagtctgtgctccgaggtcactggcagcactagccccggctcctgt

SEQ ID NO: 61 - DNA, 1470 bp, homo sapiens
  sequence of STAR61
  misc_feature (130)..(976): "N" stands for any nucleotide on various positions
cagcccccacatgcccagccctgtgctcagctctgcagcggggcatggtgggcagagacacagaggccaaggccctgcttcggggacggtgggcctgggatgagcatggccttggccttcgccgagagtnctcttgtgaaggaggggtcaggaggggctgctgcagctggggaggagggcgatggcactgtggcangaagtgaantagtgtgggtgcctngcaccccaggcacggccagcctggggtatggacccggggccntctgttctagagcaggaaggtatggtgaggacctcaaaaggacagccactggagagctccaggcagaggnacttgagaggccctggggccatcctgtctcttttctgggtctgtgtgctctgggcctgggcccttcctctgctcccccgggcttggagagggctggccttgcctcgtgcaaaggaccactctagactggtaccaagtctggcccatggcctcctgtgggtgcaggcctgtgcgggtgacctgagagccagggctggcaggtcagagtcaggagagggatggcagtggatgccctgtgcaggatctgcctaatcatggtgaggctggaggaatccaaagtgggcatgcactctgcactcatttctttattcatgtgtgcccatcccaacaagcagggagcctggccaggagggcccctgggagaaggcactgatgggctgtgttccatttaggaaggatggacggttgtgagacgggtaagtcagaacgggctgcccacctcggccgagagggccccgtggtgggttggcaccatctgggcctggagagctgctcaggaggctctctagggctgggtgaccaggnctggggtacagtagccatgggagcaggtgcttacctggggctgtccctgagcaggggctgcattgggtgctctgtgagcacacacttctctattcacctgagtcccnctgagtgatgagnacacccttgttttgcagatgaatctgagcatggagatgttaagtggcttgcctgagccacacagcagatggatggtgtagctgggacctgagggcaggcagtcccagcccgaggacttcccaaggttgtggcaaactctgacagcatgaccccagggaacacccatctcagctctggtcagacactgcggagttgtgttgtaacccacacagctggagacagccaccctagccccacccttatcctctcccaaaggaacctgccctttcccttcattttcctcttactgcattgagggaccacacagtgtggcagaaggaacatgggttcaggacccagatggacttgcttcacagtgcagccctcctgtcctcttgcagagtgcgtcttccactgtgaagttgggacagtcacaccaactcaatactgctgggcccgtcacacggtgggcaggcaacggatggcagtcactggctgtgggtctgcagaggtgg

SEQ ID NO: 62 - DNA, 1011 bp, homo sapiens
  sequence of STAR62
agtgtcaaatagatctacacaaaacaagataatgtctgcccatttttccaaagataatgtggtgaagtgggtagagagaaatgcatccattctccccacccaacctctgctaaattgtccatgtcacagtactgagaccagggggcttattcccagcgggcagaatgtgcaccaagcacctcttgtctcaatttgcagtctaggccctgctatttgatggtgtgaaggcttgcacctggcatggaaggtccgttttgtacttcttgctttagcagttcaaagagcagggagagctgcgagggcctctgcagcttcagatggatgtggtcagcttgttggaggcgccttctgtggtccattatctccagcccccctgcggtgttgctgtttgcttggcttgtctggctctccatgccttgttggctccaaaatgtcatcatgctgcaccccaggaagaatgtgcaggcccatctcttttatgtgctttgggctattttgattccccgttgggtatattccctaggtaagacccagaagacacaggaggtagttgctttgggagagtttggacctatgggtatgaggtaatagacacagtatcttctctttcatttggtgagactgttagctctggccgcggactgaattccacacagctcacttgggaaaactttattccaaaacatagtcacattgaacattgtggagaatgagggacagagaagaggccctagatttgtacatctgggtgttatgtctataaatagaatgctttggtggtcaactagacttgttcatgttgacatttagtcttgccttttcggtggtgatttaaaaattatgtatatcttgtttggaatatagtggagctatggtgtggcattttcatctggctttttgtttagctcagcccgtcctgttatgggcagccttgaagctcagtagctaatgaagaggtatcctcactccctccagagagcggtcccctcacggctcattgagagtttgtca

SEQ ID NO: 63 - DNA, 1410 bp, homo sapiens
  sequence of STAR63
gcgtctgagccgctgggaacccatgagccccgtccatggagttgaggaagggggttcgccccacggggtgggcgccctctacacagcgcgcttcctcttctctcgttagcgccgcgggaccagcctctggttctgcacctcgcgctctgggagcagcgcccggctttggcgagcgcttccccggggctgcccagcctctgctccgctcgccccgccaggcccggctccgcgaagcccccagggtccagtccaaggccccgattccccaaggccagggccccggggcagcattggaacagggcgcggacgccagtcctccgagcatggagtaactgcagcttttgagaaaagaaagcggaccccaccccatcgagaacgcggcgccttgtttagggacgttcctgggccgtcacggagtgtcgccggctcctcggcccctccctcctccaagcccccacccccgacagcggcctccctggggacctcccctcgggctgcgctttcagcccaaacacagggaggtcttccaggagcctgcccagtccccacagcagcccagagacccccactcccacctgtacctgccaagccttcagagagggcggcctggacatgccccgcacgggaggagccccgcctcagcacccctgcaagtggcagcaacccagaacacccgtgagaggcctctgagcagcccaggaagtggctggaagacgcataggcagctcactcctctgtaagagcaaggaccggagaacacatgctgacccctgcttttgcagaggggcgatgcttcaggacaggcgcgctcagcaggtgtccatcttatttcacacctttgtgtttatatcatcttattttgcattttatgtctaattaacaatatgcagctggccaggcgcagtggctcaagcctctaatcccagcactttgggaggccgaggcaggtgtatcacttgagggcaggagttcgggaccggcctgggcaacatagcaaaaccccattgctaataaaaatacaaaaattagccagccatggtggcgggcacctgcagtcccagctactccggaagctgaagcaggagaatcacttgaacccaggaggcggaggtggcagtgagctatcaagccattacactccagcctgggcaacagagaaagactgtctcaaaaaaaaattaatacgcagcagaatattatgtggtcagcccaagcagtcccccccactcagccctctgtccctacagctccaggcactcccccagcccctcccctggacaagaggtaatgcccagagggtgaaaatccaccaaggttaagccagaaacaaaaagctcaaagcttcggcatctccctccgctcagacccttagagcagattcctctcatcgacagcacgatcaggctgtgg

SEQ ID NO: 64 - DNA, 1414 bp, homo sapiens
  sequence of STAR64
agagatcttttaagggctcaaaagaccctgcggctcccctgccaatagctctgccatcgtccccagagctttcgaggaccctccaccatcggcgccaaccccagctgagctgggtgctcgtctgcaggcctctgctccatctcagcctgagcatgaggctctgctgtgctgcttccagcagcagggacagggctgatgagcctggcccttgcaagcatcttcctgtgccgaatacaattccacagacagaggatttaaaatccaagtggaggtgacaggaaagaaaggaaaacctccaggtatcagaagaaaggagggggtgtgaagacagtatgggaggaaggtcaggctggggctcagctctgggaagtgccagcctgaacaggagtcacgcccgggtccacatgcaagggaatgaggaccgaggccctgcatgtggcagggccttccgcaggctgccccgtctgtgaacaggacaccagaagaagtctgccttccagcctggcaaagtggcaaggaacctctgggtgggaaaacaaatcaacaaacaaattgtcagtaaaaaacagaaacctcacactttcctttctcttgacctcttgaaaaaagcaaatccactgcagctcaccaaaggcaaagagaaaaccttaagaatacccagagagaaaagacacgttacttgcaaaagaacatctaatgcagggagataatgaaaatacagactcttcaaagggctgaaggaaaaaaaccgtccacctagaattctatccccaaactgtcatctgagagcaagggcaaaacaaacgctttctcagacaggctggacgaggtcgctcacgcctgtaatcctagcactttgggaggccaaggtgggaggaccgctttaagccagaagtttgagaccagtgtgggtaacataatgagaccccatctctaagaaaaagaaattaaataagacaagactttttcagacaacaagtgctctgagagctggcctatcttggctgtcttgtaaagaattgctgcgagacacctcattaggaaagagactgaatctagaaggaaagagcagagcatgaggtacaatgaggagcaaataaacaggtcaccatataagcaaacccaaatacacattcactatacgaaacaataaaaatgactcatttggggggttaaaacactgttgaactaaaatcctggataacagcagcatgaaaggtggggtggtggtcccaggaaagcattcaaaggtccatgtctcatttgggaggagggtagggagactcatgaacttgaggctcccttcaggcaagcacagtgcaaaaaaattataataatgggaaacagatacagtagactgtgatgtacaactctcagagcagtagaagggagggtataaaacaaatctgatcca

SEQ ID NO: 65 - DNA, 1310 bp, homo sapiens
  sequence of STAR65
tcgagaccagcctggccaacatggtgaaacattgtctctattacaaatacaaaaattagccaggtgtagtggtgcatgcctgcagtcccagccatttgggaggctgaagttggagaatcgcttaaacctgggaggtggaggttgcattgagccgagaagcactccagcctggatgacggagcaagactgtctcaaaaagaaaaaaaaaagaagcagcagcaaatatccctgtcctgatggaggctatataacaaccaaacaagtgaatgcataagacaatttcaaggttatggtagataccataagtgggagatgaacaatgagaacacatggacacagggaggagaacatcacacactggggcctctcggggggtggggaaatagggggtgatagcattaggagaaatacctaatgtcgataacaggttagtgggtgcagcaaaccaccatggcacgtgtatatctatgtaacacacctgcacgttctgcacatgtatcccagaacttaaagtataataaaaaaagacattaaaaaattatgatataaaatcccaattcaagttgttttaaaaagagaaaacaattatctttatataatagcggaaaatatagatggcggaattaaagcctcgtcatattttctaacagaactttctgataaacttgattaaataaaaattttaaatatcactaaacacatagaagaaataaatttaaaccttcacaaaaaataaagtacaatgaatgaagacaaggtgtacttgaaaaaagaactgaataaatattctacatataaaaaaaatctgatgatattgtggtgattctttactttgctactagtttctctttttttcttctgaaaaatttcttgggatgtatttggtttcattagtaaaattctaagtttctttgcaatctgaacattggagcttcatccatagccagtatgccctaacattatctttggacaactgtaaaattagaacactgccagacatatttaatgtatgatgtatatcaacactgggacacattttatactatctttattccaaaatcaaatgattcactgtggtttataaatgtacatggatatatctctacctaagcagatagttaggagagttagtaaaaatgaggtggaaaataggagtcactgtcccttcacagggagagaattctgcttttctcctaatataccctttgcttgaacagactccaacccctcatcttttgtcctttaaatgaccacatttattttaactttgataaacaacacagaaagatatttgatccatcaacattcac

SEQ ID NO: 66 - DNA, 2500 bp, homo sapiens
  sequence of T2F (STAR66F)
gcaggttggatggtgctgacccctcctcgggttggcttcctgtctccaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggctgccagcccgtgaggtccgtgaggtcctggccgctctgacagccgcggcctccccgggctccagagaaggcccgcgtctaaataaagcgccagcgcaggatgaaagcggccagcctcgcagcctgctcttcttgaaagctgggcgggttggggcggggggcttctctggaaggcttggagctgtcccctctggccttgggggactggctgcccccggggcgcccgggcctagccgaggcggtgctcctgccggccagactctcggtcagtgcgggcacggggtcccagccactcctagggggcagcgcagccggcagggtggccgcccccgggtgggacttggaccctggactccacgggagggctccgccacccagcctggtgttacataaggggtggtggaggtgggcagtcgagcgttaaagagtaacctgctgccgggaagcccgccaagcaatcgcggccccttccccggctctggcagctctgcgagcgcgcccgtggggaacgggccctccccggcggggcgcgcgggcgcgcgaggtgggcggaggcctcggagctgtgccgggccgggcctccctccctaggccagcgcgggagcgacccggagggggcgggcccggggcggggcctcgaagcgctggccggcgggagcgcggccggccgggcccgcccgcctgcggtgtggacgccgcgcggccaatgcgcgcgccgggacgggacgggacggggcggggcggggcgggacgagacggggcggggcggggcgggccgggcagcctccgggcggcgcggcgcgggcggcggccggatccagggcgggggtcggcggcccggccagcccggcccggcccggggccgcgtcctgagagtcagccctcgccgctgcagcctcggcgcccggccggccggccatggagcgccccccgccccgcgccgccggccgggaccccagtgcgctgcgggccgaggcgccgtggctgcgcgcggagggtccggggccgcgcgccgcgcccgtgacggtgcccacgccgccgcaggtaccgggcgccggtgggcgggggcgccgaccaagtttctctcgctgcaaagatggcgtcagtgctgcccaaacttcgggcccccgggggcggggcagcggggagggcggccgcgtcggtccgcgcgtgtccgtgggtcccgccggggctgcgccgggcggccggggagcccttcccgccgcgccgggctgggggcggggccgggggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagaggtgagcgggaggcccggtgcctcgggactcggtgtgcgcaggggcggtgggtggggtgcggagacaccggccccgacggaggccaggtcagggccccaggtttgtaattaccagccacccccaagctcttcagccctggaggagctgagcagaaatgatcgatgactgggagtccctacacctccctccaccgcagttcctcggggctagagctcagaacccggagcgggtggctgtgcgtctctgtgcagaagaggctgcgcggtcggcatggggcgactgtccaggaatccctggggctcctgaccgccacctcccaacccctgccaggccggacacctcggtctggctgccagggcaggggcgggccctggcctggctcgctggggcctggggagctgcccgtgcttccagcccagtctccccctggctgctgccggctgctggccactcccacctcccaggcctggcgtgaggcccacagctgctgttgcacaaccctggttaatgtgtgatg

SEQ ID NO: 67 - DNA, 2500 bp, homo sapiens
  sequence of T2R (STAR66R)
gtttggggtagagagaacatactgattatgggactttgctttgcagcttagtgctgtcctgtcagtgggaagcaacagggggcagaactcagcttgtgcccatagagggaatgtttatactaggcctgtccagaggcaaatcatccatcctagcaattggaacctgacttttggcaagtcctgccaccatgggctaaagtgttctggggttctaaataaacatgaaaggcaacctagaccacaaggactgcaattcctgcacaagtcctggtgctgtgttgggcttggagccagggaacttggagtgcatggaacctagtgagataccagctgagacaaccaaggaagtgcttgtgtcacccctccaccaaccccaggcagtacagattgtacctccaagaccccttccatctgcttgaggaaggtggaggggaagaggactttgttttgcaacttggattccagcccatccacagtagaataaggcaacgggcagactcctaaggcccccatcccagaccctagctcctggatgacatttctaaacacaccatgggccagaagggaacccattgccttgaagggaagggcccagtcctggcagaatttatcatgtgctgaataaacagcccttgggccctgaataattagtattggtagccaggcagtatttaccacaggccttgggtgagacccagagccatgttggcttcaggtgtgacccagcacattcccagctgtggtaactttggggagagaccacttctgcttgagaaaaggagacagaagagtaaaggggtctttatcttgcagcctggtaccagcttggccgcagtggggtagagcaccaagagagcacctgggataaacaaaatcaaaaaacctttagctagactaagagtaaagagagaagacccaagtaaatataatcaaagacaaaaaaggagagacattacaaccaatacctcagaaattcaaagtatcattagcagctactttgaacaactatatgccagtaaattggaaaacctagaagaattatataaattcctaacatatacaacctaccaagattgaaccatgaagaaatttaaagcctgaataggccaataacaagcaatgagattggagccctaatacaaagtttacaatgagaaacattgctcaaacaaatcatagatgacacaaacaaatggaaaacatccaatgctcatggacaggaaaaaatatttaaatttctatactgcccaaagcagtttatacattcaatgctattcctgtcaaaataccaatcttattcttcacaaaaaaaaaattaaaaattacacagaaccaaaaaagagcccaaatacccaaggcaattttaagcaaaaagaacaaagctggaggcatcacgttacctgtgatccacactatagggctacagtaaatgaaacagcaaggtgctggtatacaaacagacacataaaccaatggaatagaataaagagcttagaaataatgctccacacctccagccatccgatgtttgagaaagtagacataaacaagcaatgaggagaggactccctattcattaaatcaactcaagacggaccaaaaacctaaatgtaaaacaaacaaacaaaaaaaataactgctaaaaccctgggagatgacctaggaaataccattctggacagtacctggtgaaaatttcatgctgaagacaccaaaaacaattgcagcaaaagaaaaaattgacatatgggatcaaattaaactttagagcttttgcacagcaaaataaactatcaacagagtaaataggcaccctacaggaagggagaaaatattttcaatctgtgctctgacaaagtcctaatatccagagcctataaggaacttaaacaaatttacaaacaaaaaacaaacaacactattacgagttggaaaaggacatgaatcgacacttttcaaaagaagacatacatgtggctaacaagcatatgaaaaaaatgctcaacattactaatcattagagaaatgcaaatcaaaaccacaatgagataccatctcaaccagtctgaatggctgttattaaaaaaatcagaaaaaaacagatgctggcaaggttgtggagaaaaggaaacacttatacattgttggggggagtgtaaattaattcagccattgtggaaagtattgtggtgattttctaaagaactaaaaaggaattactattttacctggaaatttcattattgggtatatacccaaagaaatatgaattattttactataaagacagatgcatgcatgtgttcattgtagcactattcacagtagcaaagacatgttatcaacctaaatgcccattaacagtaaactggataaggaaaatatggtacatatacactgtggaatactatgcagtcataaaaagaatgagataatgttcattgcagcaacatggatggaactggagaccattatccttgggaaactaacaaagcaacag

SEQ ID NO: 68 - DNA, 2501 bp, homo sapiens
  sequence of T3F
agatttgccctcaagattacaactgctggggctaaagtggtacagagcctgagttcagtaggcttccatagtctcactcaagaatgcaagtttacctctcaatctttcaatcatcacaattataacaactttaaaaagagccaacatgatatttgcttatcacttttctactcacattccagtattaactcaaaagtgtcaacacaaccttcgtgataaatactattaacgtcatcattcctactgtacagatgatgatagtgacacataggttaagttgcccaaggtcttattattaagggtcatagccaggatttgatctcttcagtaaagttctagtcaatgctcttaaccattaagccatgcaacacacccagagccaactgggttgtgttgatgattataatatttgttttaacaaacaataatttttcctaaatataatatagattttccataaataccataaattcttgattatttatttcactttattccaaaaggaagttgaattctgagatttaaatgaatagcaaacaacagttgcttaatttcactacttttgtcacttgtagccagtacttaaaaagagatacataatttatttttgttgatttgcatttcacatataattgtaagatcctggagaataaagactatatgtgttataccattttactctctcacacagtgtgtaggcctaggctttgtgcatagcaagtgttaaaaagtaatgtgactcgtgatagttattagatttattgaaattcagaaatttagggaaatgcacaataaaatgtacattttgtgattccggtcaaattacttaaaaattatatttttcctatgaataatttttatttcacttaaattatgtataacaaaataacatgcataattaaacatttaccacaaagaaaatatttgtactattgttatcacaataaagaacttgctacataaattcaattacacttttgtggaaagtatcttcattatataaaaacaatctacatttagaataggaaaattgtacaaaacatgaaaatataaacaaattaagcgagaattatctaaaaagcaactcttcagaatttagaagaattgtctagaataaaaagaatttagaagaattatctaagaaacaaccataaatattctgatgtatttaagactcatattctagaatcctgactattattttttatacttctatggctaatctcaagtttagctttatttttctaaagcaatgaggcctgtagaatattttttcagaattctctgaggttttttcttttttgtctttcctgtcatagtatgccaattattcatgggtttatagaatatgtatgcactgctaagagcagcaaaacaaaagatatatgtgctatttattaattcatgttgctttatttaaattacttgaaaatgataaagaaaaaactattgtatttacaacagcaaccaaatatagactacctgtaactacatctaacagaataaataaaatataacatacaatatgtagtaaatatatttataatatatatgttcactaaatagttaacctgtaacttacttacagtaaatatatataatatctactgagatagtaccacattttattaaggattaaacttttaataattcagaagaataaatataataaatttcatttgttctcaaactaatttgtttttatttgtttgttttttgtattttaatttgacagtagttccaagatattttggggtatataatgaggtgataattgcaaagaaaattctgaaaaggaaaagactaagcgtgaattgaaagtaaaattcgttaaaaggtataataaactgtgatactgtaacaataattgaaaatagataaagaaaaaggtaacatcaataaatagtctattatatatgtgaattatgttaataaaagtgacattttattttcaatccacaatttctgaaatatatatggcaatatttttctgttttattttttcaacctctgattactttattacatttttttctttttctagaatttacttgtattttctctgtgtctaatatatgattatttctgaactagcatcattggtcctggaaccagactatattattcccaaggtagagcatcaaaatataacaattaaataaatacttttagttactttaacaaccttttgtctttcattataattttggaattatagtttagtacaatacagatagttttaatatctgttagagtgaagatatatatatatgtgtgtgtgtttttgagatggagtctcactctgttgcccaggctggagtacagtggtgccatctcggctcacggcaacctctgcgtcccaggttcaagcaattctcctgcctcagcctcccgggtagctgggactacaggcgagtgtcaccacgcctggctaattttttgtatttttagtagagacagggtttcaccatattagccaggatggtctcggtctcctgact

SEQ ID NO: 69 - DNA, 2511 bp, homo sapiens
  sequence of T3R
cttttggtgccctgtcccttataatttcctcgtgtgtcctttcccatttgcttatccgatgacttgcttctctcacccattggattgtgagcctcttgtggtcaggggcagtgctctgtaagctgctgtgtccccagaatctggcccagtgtaggcactcagcagctatagactgatgttaagagaaaatgcacatttcatctcagcctcagagcagttctgggaaacagataggaaaccaaagctctgcaagaacgtgggactctctcagggccatcacaacactgttgttggtctcatgtttggtgactgggtctcctattcctggtctctttcctaggcataatgcttttatataaagtcccttccattgtttttttgtttgttttcttttttcagcctaaataacttagtttctctaaacttttctcccagggactcttttttaaccctttgaattattgctgattattatcttaataacttttattttttttccattttgcatgtcatattttagcaaagcattaaaaggaacacggcacaaagcacacccatatttttggatgctgtggatttcatcatgctgcttattccattatatctagtcagtacctccaaggcattaatgctgccttacctccttcattcgaagacttccctgtgcaaggtggaatatacgtaaggaggcaaacagactgggttatatgcctgctctgctttacagaggcctcttccaggagtgtaatacgggggttgctcatactctgaagaagatagtggcaggctattactgtcatgagagccagaacgtggctggcttcttacagacatggcttcataggggcatgccacgtgattcctgagtaagccttctggtgtgaattccctgctcactggggtgattcttcacttcccacagttcaacctgctgtattatcctcttacctatgcttttctgtgatccatagaggtaatttaattttcagtccatgtacctaccctgcctacttagtttcttctcagtgccacacttaattccttcacatttactgattaattaaatgagaagactatgccaggtgaaggttcagcatcttcagaactctacatgatgcattccctgaggctgcctttcaataactgaggtgatattctttgagcagtgtgacctgttagaggtgcccagtcaggtccgatgaaaagccctctgatttgttgaaatagtgcattagtaaagtattatagtttattttcacaaagctagattagttgttacatgttggtttttgttttgcctagccctaacaagtatggaggtgaccttgatgtgtctatagaatatcaggaatatctggctgggtgggtggctcacacctgtaatcccaacaatttgggaggccgaggtgggcggatcacctgaggtcaggagtttgagagaggcctggccaacatggtgaacccccgtctctactaaaaatacaaaaattagccaggtgtggtggcaggtgcctgcaatctcagctactccggaggctgatgcaggggaatcacttgaacccgggaggtagaggttgcagtgagccaagattgtgccactgcactccagcctgggcaacagagcgagattctgcctcaaaaaaaaaaaaaaaaaaaaaaaaaaaaaaagaatatcaggaatatccattttatgtctcaactcacatacctcacagttttctggtccaatttttaggcactttatcaggccctcatatgttttcaaaaataattgctaatgactttgatgaagctaggcaagatattttttggttttagggcagtttgggctatagtttgcagccttcctactttaatagaagaatttttaaactagattctcccccttctcagggtggctttctgcctttccattctagtgcttcacacagaaatgacaagctcacaggggacttatctagaaaaggccgagataaaaataagtacaatgttaaaaaaatctatcttatagtatcatttatttagagcttcctctccttttctaatgaaaggctgctgtagtttccttttgtgctttttttgctgaaggcttttcagtaatattcccgtgtgtcccctgtgatgctaaaagcatgagcttgggggcaggttgactggcattcaggtctttgctcagcctccagccgcaagacaaggcgaataatattgatctcatggagctgaaatgaaaattaacttttctaatctgtgaaaatgctttgttataatccttaaatacatgaatacataggttgaaatagcaagtaccaagtgctgacattatgtccacaattgccacatgccatgtccttatgatttttgccagatgtttaataagattataaatgaataggttattaaatgggcatctcctactctctaggtgtttctgtttctgcttctctgttttctgtttgtatctccatttattttaatgcctaccattatgtgaagtctgccaccttcctatac

SEQ ID NO: 70 - DNA, 1500 bp, homo sapiens
  sequence of T5F
gaactcaataggggtcttgtacggagcaggggcttggtccctcgtacctctggccatacctatggagcccaggggatgcttggcagcacctgggaggtgccaaccccgggtggcaagggagggccggtcccacgctcacattgtcttctgttctctctctctctttatctgtgtcgatgtctctctctcttcccccgtgcccgtgccatcctctccacccctggattcctgtctctgcttggctttcacccacttctcctccccacccacggctgctcctcctcctgtccccacctcctccccgggtgcaggacgggcctcttcacacctgacctcgcttttgaagccacagtgaaaaagcaggtgcagaagctcaaagagcccagtatcaagtgtgtggatatggtagtcagtgagctcacagccaccatcagaaagtgtagcgaaaaggtatgacggccgcctgggcggggctgggcctggccgtccattccttgtggccacagcctcccgtgggcagaaggatctgctgagccggcctcacggctacccgcagggacccagccctagtgtttcctgccagtttctaaccctgggtacttgcactcatgacccctccaggcccccatcccagaagacttgactccaacccaagcctccttggtggcacctatgctagtgatgaagatgatgttaaggagatggcagctgtttactgagcacctactatgtgccaagcacacgctaagtgcttgcccttactatctgactcagtcctctcaaccaccctaagacgtgggtagtgttgttattcccattttgcagatggcaaaacagagtctcagaaaagagaagcagagtgtgattcagttttaggaaggacagaggaaggggtctgaggtcagggcctcctgggcagggggagctgtcctagttcctcaaaaccaatttgcctgaaagcatattggattactcactttacagtaatccgtgcgtgagagacaggggcggtctcttttgagttgtctgtgactttttagatgcctttttcctatttgtctgcttttgggcattttgaggatttttagccaggttgtctaaagcagttcttcccaggggagtgcgagagaatcagttgcctgcaggagcttctccagcaggctaaatcagaggtgccaggggtgagcccagcctcacctatatctgaaggacttccctatgctggtgggtggaggcacatccaccttagcattgagtttcaaataagcatcaatcatctccattcctttttttttttttttttttttttgagatggaatcttgctctgtcgcccaggctggagtgcagtggcaccatcttggctcactgcaacctctgcctcctgggttcaagtattctcctgcctcagcctcccgggtggctgggattactagcatgtaccaccacacctggctaatttttgtatttttagtagagatggggttttgccacgttggcca

SEQ ID NO: 71 - DNA, 1500 bp, homo sapiens
  sequence of T5R
gattacaggcgtgagccaccacacctggcccagtggggtccttctaaaatgcaaagctgatcatgtctcttcttccaggcttaaagccctcccatggcttcctgcagccctggtgcacgccttacgccaagcctgaaaacactctgcacacccaccccttccctgcacaaacgggcctctgcacactacctgccccggccatgcccccgcaaccagccctctctgcttatctaccttggccttctctctggtcaagccccaggcccgtccctgcccctaggccttcacttagagcctcagaagcacttcttgcaggaagccctccagactccagaatgggtccagaacctacttccttttcgtggcatttctgtattctttttttttttcttccatagagccagggtctcactgtgtttcctaggctagtctcgaactcctgggctcaactgatcctcctgccttggccttccatagtgctgggattacaggcatgagtcattgcacccggcctccacagtcttaattaattggttggagcattatttgcattaatatctctcaccaccctccccattcctgtccaagacctcagggagggccaggccagatgtatcatctgcaccagggagtcccctgcaggggcttccagatgtctgctaaatgaacacacagctctctctggccagtccaaggcaccccaggaggccaccagaagcctgcagcctccctccctccctcctgctaagcccaaggaatgagcactgagcagggaatggtaatctggacacatccatactctgcccttcagaaactacctagctgtcaccctgcacgaaacaggcaccagcctgagagtcaggaggcctgggctctgggtccacctagacagctgtggggcgcaggaccaaccgcaccccaatctctaagcctgggtttttccatacgtaaaaaaatgagggcagggcgggttagacactagaccagatctgtgatgacaggcccgttggaaggctggaggcggggcccctcgctgaaggaaaatgccttacctccagaagtggcccgccctggagtggccagcaaagggggcattgcccctgcgctggaatacacccagaagcagggtgtgagcaggagctgcggagaccttcagggacaggacagtctagggagggggtgagccctttgcagatctcctgcttatgccaggagaaaggtaaacacctctcaaacacacaaggagccagggggctgtgggctggaacctatagccggcaacagcgtatagcttaggattttatagcattgttctaccctagttatgtttcctatacttttgtttgtttgtttgtttgtttgtttgtttgtttgaaatggagtctcactctgtcgcccaggctggagtgcaatggcacgatcttggctcactgcagcctctgtcttccaggttcaagtgattctcctacttcagccttcctgagtagctggaattacagg

SEQ ID NO: 72 - DNA, 1199 bp, homo sapiens
  sequence of T7
ccatcttataaatatatcataatttactgaaaaatatttcagtaatgttgaaaggcctctgtgccatttccagcttgaggctattcctaaaaatccttgcacatgtctttcagtgcacacatgtatacatttcggttgggtatgcctaggagtggaatgactggttatagggtacacttacgttgagctttggtagatactaccaactgccagttttccaaagttgtaccaatttacattcctaccaccagtacatgagggttccagatgctgaacgtcctcactaatgcttggtaatgtctgcctttttcattttagtcattctggaggtagtgtgataatatctcatcgtggttatttgctttagcctgatgattaacgatcctgaccattttttggaacatttggagatcatcttttgtgaagtaactactcaaatattttgcccattttgctactgggttgttcaaaagattcattaaaagaacttcttttatatatgggtttgtagttgttatttagatattctagagactagccagatccctatactacaaatactttctcctactttgtagtttgcctttttactttcttttatatacatataatttttccccctccaaaagacagggtcttgctctgttgcccaggctggagtgtagtggtgcaatcatagctcactgcagccttgaactcctaagctcaagcaatcctccttcctcagactctggagtagttggaacaataggcacatggcattatgcgcagtcaactttaaaaaaaaaaaaaattgtagagatgaggtcttactatgttgttgcccaggctgatctttaactcctggtctaaagcaatcctcctgcctcagcctccctcccaagtagctaagaatacaggtgtgcaccaccacatctagctttactttcttaatggcgtcttttaatgaacagataattcctaagtttgatgtagtcaaatcatcattttttcctttatagtcagcatttatatccagttcaagtaaagaatatcatgaaaacattcttctttgttttcttttagaaactttcataaagtagcatttaaaatgtgaattttcctataatcctagcacttcaggaggctgtgccaccgcactctagcctgggcaacagagcgagaccttgtctcaaaataaaaaattaaaaaaaaaaaat

SEQ ID NO: 73 - DNA, 1602 bp, homo sapiens
  sequence of T9F
tgagcatctctgaactattgcgccatgtatttccaattttcatattgtgtatttgtatattttatatgtaatagtataggtgtaatatgtaaatatattttatatgtatttaaaatctttatattttgaagggttttgtttcaactattacttgttaatttcacagtccctttctttgatgttagcaaatagtaccttcatgaacctcagaggacttggatctgaatgtgcaatgccctctagtatttcaaataatagttcagttggtatagtatttttttaatctgcaaaaaacaatacttgctaatatagctatgttagagtaaacaataaatcgagaataaatttatagcctttgaaacaaaacaaaccaaaaattttactcctttttggctttcatccctgcactggtatcttaacttctgtttgtataaaagaataccattttttcacagaagacaaagaacaatcagccaatctaataattattttatggccatgctctgaaatacaattaaaattatgattgtggacaatatgccttttcgggacctggctgatggtatttctggtgtgaccccaactttccagtcagttcagggcaataaacattggatacaggacagctttggggatgaaatagaattaaatttagtgtagtttttgccacttttagctggatgcctggcgaggggttttgtgccctctgagagcctccgtcttctcaactgaggggtggttgtgagttttgggtcaaatgcttggtgtttagtagatgcttggagcttccatgaaacatgcaaccacggcgttgctgctatttgttcagatgcgagaggaacatgacttttggctgcctgagtgttctcatagcatctgggccttccttgtgagatcgtcagaaagtgtttcctgcacaaagcctgtactgcggccctggcgtggggctgattgtcccgctactctgctgtgatggctgaattcaaagagtggccgataggagcacgtatggtgggtgccttgttaacagctcatagcagaaacgtgacaagcgggagagggctttgggttgtcctgaacttcaaacacctgtaactgctgcgggaagagcggcacgtggatgaaacggacacagagggggaataggcaggaaaggacgcgggctcttttcgaagcagcaggtctcaaggcggccagccactggcgcagctgcagctgaagccacggcagagtctccatccttcccactatctgctgaatcagagaaagtggcaggcaacatttttagtgccttaaatttagaacgcttgctcaaaatcagaccctacttaaaataaggagcgataccctcatttcttaaatagtaaaaatgccctcagcagaattaacgggagtatcttccaacttcatatcctgaatggaaaagtctgtccaccatcccgaggacgtgtttgaagcgcagtgtgaaaatccagcacgtcgtggaccggccagacccctgtgccgtgagaggcggggcggcggggccgtggggcgctcgcactcccgagctcatcgtggcatgcgctgagccgaaaaccacgaggtagagggaatgagatc

SEQ ID NO: 74 - DNA, 1602 bp, homo sapiens
  sequence of T9R
gagcttgattgtctggccgcgaaaacagggcaggcccgtgtccaacatgatagtgaccagggagacgaccacatccatgtagggcctggggagagacaggagggagcggtgggctgaggccagcctaggtggtggccctgcctgtagtcctgtggactggctgatgccaacagcctcaggtgtgggctcctgccacccacctcgcctgccacatcttgcacatccccgaggcaactttcgatctgctgcactcggtcacccgtactgcccaggcaagggctgcccatacgcactctggacaggctgagtgtcctgccctgtcccccacataaggctgccggccatggcttctgcacctgggtgggatgcagacacgctgacctgcctttctctgcggggcagtggggatgaacccaggttggactgtggccttggccaagtgacctgtatatgaaactgggacaaagcccatctttggcacgtagcctgtggggtggcaggtgctcaggctttggtgacaaggtggatgggatgcccagaaagggagagcccatggctgaaggcgtgggcaggattgtggggaaggtggttggaattagatgcccagagcaagaatttattggcacaggtgggcagacagaggtgaccaaaggacaggtgtaggtcagcaggtggctgctagcacctacctcactctctggaacccgattcccttcatcctaaaggggatctcagaacgttccacacaccccctccgcctccaccctggccctcacccaggctcaccgcacagccaggtagcctggacacacatctccatgaaccacttgaagggtgtggcctccatcttgccccccatgatcatcaccatctcatccgtcagcttgatgtcgggttcccagccgagattgccgcccggcgagctttcaaacatgaagccaaagtctgcaaaaccccaaagagctgcctgtgactgggtaggagccagggcgggcaaggacgagtggtctgttttgaggagtggaaaaggactcttcaacaggagcaccccctccacccccaaaaggcaggttgtgttttcttggagacagtgatggggtgggtggtggggcagcaggcagagaaagagaagggaggaagtggaggaaggagccaagctggggcactgaacctggaccagccccactccgcccagctccagcttctgactcagagcaatggcggctctcgccccagctccctggggccggggccaggcaccctctacagcagaacagcttggtggccgacagttcggacctcagagctggaccctgacactcctggcagggtggtcctgggcattctcctctctgtggggtggggatccctatccacccctgggtgccggggtgaagggagaggagggtggcgctgtggctggctgaccgatgtggatgatatggcccttcttgtccagcataatgttgccgttgtgtctgtccttgatctgcagcaggaacagcaggaggctgtaggcggccatgcttcggatgaagttgtagcgggcctgtgcagagagcgccctgggctcaaaaaggccctggggcctgtgggcattct

SEQ ID NO: 75 - DNA, 1301 bp, homo sapiens
  sequence of T10F
aatcaaactggacccttatcttccaccatatacaaaaattaatgcaaggtggattaaagatttaattgtaaggcctcaaactataaaatcttaaaaggaaacctaggaaataccatctggacatcagccttgggacataatttataactaagtcctcaaaagcaattgcaacaaaaaacaaaaactgacaagtgagacctaattaaactaaagaacttttgcacagcaaaagaaactatcaacagaataaacagacaacctacagaatgggagaaaatacttgcaaactatgcatccaacaaaggtttaatatccagaatccataaggcacttaaacaactcaacaaacaaaaaacaaataacttcatttaaaaaaagacatgaacagacacttctcaaaagaagacatacaagtagacaaaaaacataggaaaaaaatacttaccatcactaatcatcagaaaaatgcaaatctaaaccataatgagatatcatctcacaccagtccaaatggccattaataaaaagacaaaaaacaacagaagctggcaaggctgtggagaaaaaggaacacttatacacttttggtgggaaagtaaattagttcagccactgtggaaagcagtttggagatttctcaaagaactaaaaatagaactaccatatgacccaacaattccattactggttagatacccagaggaaaataaattgttctacaaaaaagacatgtgcacttgtatgttcattgcagcactattcacaatagcaaagacatgaaatcaacctaggtgcctgtcagcagtgaattggataaagaaaatgtggtacatatacaccatggaatactacacagccataatagaagaatgaaatcatgttctttgcagcaacatggatccagctggaggccatcatcctaagcgaattaacagaggaacaaaaaaccaaataccacatgtcctcacttgcaaatgagaggtatatatagacataaacatgggaacaatggacactggggactcctggaggagggaaagaagtggcaggcaaagggttgaaaaactacttattgggtactatactcactacctgggtaatccgctagtagggatcatttgttccccaaacctcagtatcacataatatacccatgtaacaaacctgcacatgtacccccgaatctaaaataaaagttgcaattattaaaataaaataaaaataaagctagcaatgagccctatacatgaaaatcaataaaacataatcatggctgtatagaggggcttgtcatttatagc

SEQ ID NO: 76 - DNA, 1300 bp, homo sapiens
  sequence of T10R
aattttacacacacacacacacacacacacacacacacacacaatatcgctcagccttaaaaacatgctactaatcggctttaagaaaagaagaaaattctgtcatttctgacaccatggaagaacttcaacattacgttaggtgaactaattcaggtacagaagaatactacagtatctcacttatatatggaatgtaaaaatgttgaactcaaaagtagagaatggaatggtggttaccaggccttgagagagaggggtaaaggttggtcaaaagatgcaaaatttcagttaagaggaaggagtacaagagatttattgtacatcatggtgactataattgataacaatgtgcttttttcttgacaattgctaagagtagaatttgtttatgggcaccaagcttgattccaagtctttgctattgtgaatagtgctgccatgaacatgcaaatgcgtgtgtctttttggtagaatgatttgttttcttttggatatatacccactaatgggattgctgggtcaaatggtagttctaagttctttgagaaatctacaaactgctttctgtggtggccaaactaatttacactcccattaactgtgtctaagtgttcccttttctccatgtcctcaccagcatctgttgtttttttgactttttaataatagccattctgactggtgtaaggaggtatgccattgtggtttgatttgcatttctctgattagtaaaatgaagcattttttgtatgtttgtcagccatgtatatgtcttcttttgagaaatatctgttcatttattttgcccacttttaaatgaggttatttggttttgcttgttcaattgtttaaattctttatcgatgctgtatattagacctttgttgaatgtgtagttttgagaatattttctctccttctgtaggttgtctgtttactcttttgatagtttattttgctgtgcagaaactctttagtttaattgggcctcatttgtcaatttttgctttcgttgtacttgcttttggtgacattgtcacaaattctttcctaaggtcaatgttcaaaatggtgtttcctaggtcttcttctaaaagtcttatagtttgagggtttacatttaaatctttaatctatcttaagttaatatttgtatatggtgagagaaaggggtccagtttaattcttttgcatatgactagccagctatcccagcactatttattaaatagggagtactttcctcattgcttatttttgtcgactttgttcaagatcagatggctgtaggtgtgtg

SEQ ID NO: 77 - DNA, 2001 bp, homo sapiens
  sequence of T11F
tctttggggtatgattatatgtctaggtaaaactcttttaagaagatgaagcagagaggattgaattgacaaagacagctctttaaaaattaaggttatttcaagactaagaacataactgcttaattgcaggtaataacagaaaaaacttggaaataaacatcccattatttgacctccaaggcagaagactggcaccaaggaaatggcagcttcgtccctttcctgtcttgggcattggtaaaaggagttgtctagacatgtttgatttctgtttcagcccttattagtagttatgccatggcaaattattcaatttctctgactcagtttccttattcagaaaatggaagcataattcttgcctcatagggccatgaagattaaatgaggggtgtcttgaagtgtctgggacataaatcttcaataaaagctaattccttttttttacagttatctcaaaccttttagtgaattggtgcttatcagtgagctttttaggtgatgcaaagaccctgctttgctcattttaaggaacagttatttttctttctccattttgaagtttcttgtttgctgcctggttgatatggtttggctgtgtccccacccatatctcatcttgaattgtagttcccataatccccacatgtcatgggagggacctggtgggaggtaattgaaccatgggggtggttaccctcatgctgttcttgtgatagtgagtgagttctcacaagagctgatggttttataaggggcttcccccttcgcttggcactcattctctctcctgttaccctgtgaagaggtgtctcctgccgtgattgtaagtttcccgaggcctcccggccatgtgaaactgtgagtcaattaaacctcttttctttataaattaccaagtcttgggtattccttcaaagcagcatgagaacagactaatacattggtttaaattagaatgccaaaatttaaataatttttatcttgaatagtagatggaattaactttctcttgaaagatatattttaaaaaattgaacttacacagacagttttgaaatggtcttattttagttttatttatttatttattttgagacagagtctcacagtgtcgcccaggctggagtgcaatggcacaatctcggctcactgcaacctccacctccagggtcaagcgattctcttgcctcagcttcctgagtagctgggattataggcgcccaccaccatgcccagctaatttttgtgtttttagtagagacggggtttcaccatgttggccaggctggtctcgaactcctgacatcgtgattctcccacctcggcctcccaaagtctcaggattacaggcatgaaccaccgcgcctggctgaaattgtttttattatagatgttgcttgtgcagttttgttagaagttcgtgacttttaacagtgatgaaaatacttcgtcattcaacaggttatttttctgctggttgtaggttatttgtaaggaactgttagtctcctatctgggtggacatgtaatagtatcagttactgaaccagaactttaaacacctttctgatactcacactgggaggtcaccaagtatctcagaataaaatgtcccaaactgaacctaccatgttcccagaaacccagcccttctcaaattcccagacttggtgaatgggagcctgtccttgcagtcttgtagcccaaaacctagggcttaagaacaccttcttccttactcccatatgcaacccatcaagttccatgcatttcatctcctaatctcaaatcccttcacccatctccacagccaccccgctagtccgggctgccattgtctctcacttaaaatgttgttattgtctaactgaccttcctgaaccctttcttgcctctttccagtttattttccacactacagccagaaaaagcttttcaaaatacgcatctggtcacctgcatacctgtctccagaccacatacaataagccttca

SEQ ID NO: 78 - DNA, 2001 bp, homo sapiens
  sequence of T11R
tctgccagcggctcccgcgccaggtcctcgaagcgcaccaggcggtagcggccgcgcaggaagggtggcggcttgagtgtggcggcctcggcgatgcgcacgtggctgcggcacacctcgcgaatcaggcgcaggtgagggtcggcctccacccacttgccgttggtgcccagcacgatgccgttgtcgcgtgccagtatcgggcccgccgcctcccgggagcgcagcacggcccgcgggtcgcgcaccaggtgcacgatgcgcaggttgagcgcggggtcgctgagcagcgggtagagcacctgcaggttgaagaagcgcacctccttgagcaccacgtggctgtaggagcggcaggcctcccgggccaggctgaatggctgccgcgtgcacagtgtcttgcatacgtcctgcttgctgatggtgcctcggggaaaggcgctgcaggcgggcggcgagcacagcgcgcggctcgttgcccagttgaaaaaggcggacaggtttcggctctgtggcatgtaggcatcaaacacgtccatgtcgcacaaaaagatagagcgcatcaggtcgcgcacggccatgtgcagcgttgccgcgctgccctgcgacagggtggtccacacatgccacgcgggctccatcaggtagaagacgtcggggtgctggctgaagagctggcccaagaaggatgagcccgagcgccacgaggacagcaccagcacgtgcacacgatcctcgccgccggctggggatgagggccctggccgggagatgatgaagagcaggaggcaggtggtctgtgccaggaggagcactgtcactgtcttgctggagaaccgtggcagccacatgcgggcggctgggggccttcgggtggagtgggcaactttagggacccgggccctcatgcccatcccatgccccaattactgcccagtgccctcagggatcagccctcagattcggctaccctacccattggacttcccaagactcccaaggtctcagtcgagcactttcccaggaatacggagtcaagacataggccagaatatagtctgtgctcacagcagaagtccagttgcagaataatgtgggatatcatcaaactgtctacctacccacccacccacctacttacatacctacaggctatctatctgtagagagaaatactatgtttcaaagagaactcctgtcttttgcttcaggatacctcttagagagacccttttaggttgtggagctaaaagggcttgatgggggcttcggtggatgtcagagcaccaccaggctcgccgaggttgaatcctggctctgccacttcctagcctatgatcttgcttatgaagatcacttaaatctctctgtgacggatcactttacccgtgtgtgaaagagggataattccggtacctggctcacaggatctggggggattggggggttattataatgaagatgggggaagggaacacgcagtcatgcccataactgaggattgcaccttttacaaggtgtgcttctgtattatataatttttttaacaggcaggtataaaacttttgtcagccaggcgcggtggctcacgcctgtaatcccagcattatgggaggccgaggcgggcggatcacgaggtcaggagatcgagaccatcctggctaacacagtgagaccccatctctactaaaaatacaaaaaattagccaggcgtgatggtgggcgcctgtagtcccagctactcgggaggctgaggcaggagaatggcgtgaacctgggaggcagaggtggcagtgagctgagattgcgccactgcactgcagcctgagtgaagagtgagactccgtttcaaaaaaaaaaaaaaaaacaacaaaaaaaaaacttttgtcattaaagataaacaagtaaataaagtggacaaagaacagcaactgttgtcatcactggtggggagtgaagtgctgtaggcagcatgggctccagaaggagggtgtcctggag

SEQ ID NO: 79 - DNA, 2100 bp, homo sapiens
  sequence of T12
tggcatccagcatggagcccacagcttccctttgtagaattgcccagttgttgcagagtgctttggtctcaatgggtctaaagctcttgatgatataagagcttcaacttccttttccctctcctccccgcaggctgcacaatgtcctggtgaatcacctgggacttcagagctctgccaccctgggtgtgaagctcaggtctgctcttggtagcttggtcagtgtgaagtacaccgtgattttgggcaagctgcttaacctccctggccctccgtttcctcatctgtagaatggggatattcacagaacctacttgtagggccatggtgaggattaaatgatgaacagtgctggcaaacaggaaatgctatataagtgtccctagcaatatacacaccgcacatcctcagtcaccacgtgtgttcactgaggtatgggccatgtgtgggtggaattgtgttccctaaaaagatatgttgatgtgctaacttgaggtccctgtgaatgcaggaaaccaaaatatttcttctcaaaatagtgaggattgttaagttaaagacactgaaaatgcaggggaacactgccttggcctctacttgcctgatgacaggcacgaatccttccttacttaagacacatcacttgcttatcagcccagagaaagcacctgcaggcaccaggaaaatctaggaacagattttactctcttcccacattttcccactttttcaaacactgaaactgctctctcctttgtcttgtcactagataggatttatggctctttgttaaaatattgtttaagcaaggcttctacgccactagcttgagagagaaatacttttgaactgaggcctcttccgcatgataggcagagcatgcattaatacatttctgcttgtttctcttttgttaatctgacttttgttttccagagtgtctcaaataagaacataaaagggaggggagaaattatagtttctcccctacatgaacttattcggatatagggtctttgcagatgtaatcaagttaagatgaagtcatatttgattaggataggccctaattaaatatggttgctgtctttataaaatgagaagaagagaccaggtgtggtggctcacacctataatcccagaactttgggatgccaaggcaggaggattgcttgaggccaggagtttgagactagcctgggcaacacagcaagactccatctccaaaaaaattaaaaattagctgggcatggtggcatgcacctgtagccccagctacttggtgggctgaggcaggaggatcaattgatcccaagagttcaaagctgcagtgagctatgatggcaccacggcaacctgggtgacagagcgagaccctgtctcttaaagaagaaaaaaagaggagaaaaaaacagagacacagaaaaaagtccttgggatgataaatgcagaaattggagccatatatccacaagacaaggaaccaccaggattcttgggaactccagaagctaagaagagggcatggaacaggttctaccctagggccttcagagggagcgcagccctgcagacaccctgagttcagacttctggcctccagaactgcgaaagaataactttctgttgttacagcagccctaaggcactagtacaggtgacatgtattgctcttctgaagagcagggtgtctacagcggcagaggtctgggtcctggcacgtgccctttaggattccaatatccttaggggcctgctggtgctgacagttccagaaccataagacagaattcctgcgggccagtttggaagcagagacaggaaactggaagagcccttagcctgtgcttgggcttaaagccctttagcttgtggctttaactctgaaacttctagagggcatcttgcaggtcagtgtgaggtacagaagttgtcacaagcttcctggctcaaagaaagtgagacttcacgaacttttctggacatcacaccagcacttatgaagttatcttgttaagcacagatgaaatcagaaatacaggcattcaccatcacttaaacaaagctcagattgtagagtgcgaggaagaatcggtggga

SEQ ID NO: 80 - DNA, 1700 bp, homo sapiens
  sequence of T13F
cagatctctaaagtattgggtgtggactagagctctggacggcctaaaggaaaggaatgtgccggttcacagggacccgcggctaagctcaagggtaaaatacagctttacaaagcatctttaggctgttccttcccaaacgtgcttagaagggaacagggaaaggcgggtgtgttttctcactgaggttcttctagtggctggaatctgatagagtaccaagttgtagggatatggatatattttccctttggcactccataaagctaaatgttgggctgaaaaaaggatgcagcctataaacaagtatttttcctgaaaccaactgcatgaggaaacgctgcgctccccctcagggagcagtttctgaagccagctgagcacagctggcactggccagagggagccctccaccctcccaccacgtatgcccacctgcaaacctgggttctgagtccccatgcaggggacagacctgaaaattccagtttgtgtcctttcaggtcatcgacaggaatgacagcctggcaagctgcagtgactgcacacagctaccctgtgagctccacttgtgtgggtgcaggtgggcgacaggagtgtgtgacacagacaggcactccaccaggaggaaacccacagcagacgtcaaccatcgctttattaaggctgcgagtcggggggctgagtcatgcactccacagacacccccactgctcccaaggtccacttttggatgaccctgaaggcagagactcctgagatctgggccacaatctagggtgagccacccacagtgccctgctggacaggggggtatgcggactgcacgggggggccctcagcaggggtcttcctgcctagggtggggctggctccagtgggtcctgggctcaggcagggggggtggcagggaggcagggacatccccccgccctctggcctatggctttgttgccctattgccaccagcgcagaagcaatgtgctataccgtgaggtgatgaagaagagccccgggagggagcaggcagctctgtgcctggggcctggccagacctcaggggtgctgtggccctgctcctgttccccctcagctcctcccagcaatgggtctcctccagtggaggtcagtcactcagaagtggacccgcagcacgtcttggctagcaaccggccgctggcaggctgtgcacgtcatgggcagggagcgttgcttctcacccaggcagggtcggcacaggaggtggccgcagggcagctggtacaccggctcctttttgaagtagggagaaaatactcttttgcaggaggcacattcggggcccaggatgctcccaggctgctctggtaaatcaggaaggaaaacaggccagggttaggaaagctgctccatggtccaggctgctctgaggggcagagccttcccaccgtgctgctgcagcatctggcttcatccctcccgagtccatcccagtctgatcaggtaggggagtggaagcgggagagggagcctgggaacccgggaggcctcttctctatcatctttgaccaaatctcagtgcctctacgaatgcttgagaagagctggcttctgagggcagcaggcaggactgggcccttcctcctggtctcccagcaaggtttactttcccctgcgataggtggccaaggctggagcaaggcacagctcactctgacaag

SEQ ID NO: 81 - DNA, 1701 bp, homo sapiens
  sequence of T13R
gaatctgaccactcagtcccacatcccaggattcagagaaaaagaattccagtgagggctctggaccccacacagctaaggcttccagggtttaggcaagccctgagggacacccatcataattacccagacgggggcccagcatcccgccccagcattctgccttgcaaggagctccctcaccagggctcagggaagggacagcctgcagttccagcaagggaggcctgcagagtcagccacaggtggccactatcggttgcttggtgccaacttagtgtgagggggcagggcccagactcgagggtgccattaccgtcccccatcgtgtacttcttttcctcgtagcttgagtctgtgtattccaggagcaggcggatggaatgggccagctgggagagatggcccacagctcgggtcagagatggagggtccctgactttgtgacgactctgcacaaggggagccccatctcctcctctcgttcctgcctcacccgcccccaccccgcacgcccagccacacgcacagacagcggcaagcacagaccccgctgtcagggacagccctgaagaggaaccgtccctagagcccgtcctgcagctgctccacacttccccgcccccacgcacccccgtcccaccgcccagcggaccctggctcaccccgcggatgttccagtaccccagtgtcatgggcatggtgctggttgctgtggattctgcagacaggcctcagcggggcggggctcagcgtttgtgagaggcccagagagggtagaggggaagccttgctgcgaccccgccccacggcccgccctgcccccgaaacgggccaatctggaggcctggagcgcgctcatggggctaggagtaggatctcctcccacctcccagccccgtgggtttcaggagagagatcaggacgcccagaagcccagggcgggggagaactggttgagtccaggggttcaagactgaactgagctatgatcgcgccgctgcactctaggttaggcaagaaagaaaggctctctctaaaacagagagattctgaataaagtaataatagcctaataaagaaaaataacacaaaagaacatttggtgctcagggattcactggataagttttcaaaacttttcaatgtatgatagagattgttataaactgcggacatacgtggcatgacagacctaacgtgggaaggacaacacaggcaaggatgattataactcactgtcacttatcagcctaaatccaaacgtcaggaataccgcctcagagaaaagaaaatgatgtttttgtcataagtggtgctgtgctcctagggagcttgctgggtgggaagagagacagaaaggtggggagcaggggctggtggacttggggagggaggagaaagcccatgtggaaacgttagaatctggggtaatcagaggtctttgtattcattcgttttgtaaatttctcaaactctcatgttaaatcaaaataaaaagttaaaaaaaaaaaactaccaggacagacatacacaaatattattaactgaaataaatgttccatcaaaaaggacttaccttaactacatgagttatattatgatttctattattattattattattattttaatattagtatccatccagcacaccactggtcttcaagtggaggtaactttgcccctcaggggacatgt

SEQ ID NO: 82 - DNA, 1482 bp, homo sapiens
  sequence of T14
  misc_feature (132)..(978): "N" stands for any nucleotide on various positions
atcagcccccacatgcccagccctgtgctcagctctgcagcggggcatggtgggcagagacacagaggccaaggccctgcttcggggacggtgggcctgggatgagcatggccttggccttcgccgagagtnctcttgtgaaggaggggtcaggaggggctgctgcagctggggaggagggcgatggcactgtggcangaagtgaantagtgtgggtgcctngcaccccaggcacggccagcctggggtatggacccggggccntctgttctagagcaggaaggtatggtgaggacctcaaaaggacagccactggagagctccaggcagaggnacttgagaggccctggggccatcctgtctcttttctgggtctgtgtgctctgggcctgggcccttcctctgctcccccgggcttggagagggctggccttgcctcgtgcaaaggaccactctagactggtaccaagtctggcccatggcctcctgtgggtgcaggcctgtgcgggtgacctgagagccagggctggcaggtcagagtcaggagagggatggcagtggatgccctgtgcaggatctgcctaatcatggtgaggctggaggaatccaaagtgggcatgcactctgcactcatttctttattcatgtgtgcccatcccaacaagcagggagcctggccaggagggcccctgggagaaggcactgatgggctgtgttccatttaggaaggatggacggttgtgagacgggtaagtcagaacgggctgcccacctcggccgagagggccccgtggtgggttggcaccatctgggcctggagagctgctcaggaggctctctagggctgggtgaccaggnctggggtacagtagccatgggagcaggtgcttacctggggctgtccctgagcaggggctgcattgggtgctctgtgagcacacacttctctattcacctgagtcccnctgagtgatgagnacacccttgttttgcagatgaatctgagcatggagatgttaagtggcttgcctgagccacacagcagatggatggtgtagctgggacctgagggcaggcagtcccagcccgaggacttcccaaggttgtggcaaactctgacagcatgaccccagggaacacccatctcagctctggtcagacactgcggagttgtgttgtaacccacacagctggagacagccaccctagccccacccttatcctctcccaaaggaacctgccctttcccttcattttcctcttactgcattgagggaccacacagtgtggcagaaggaacatgggttcaggacccagatggacttgcttcacagtgcagccctcctgtcctcttgcagagtgcgtcttccactgtgaagttgggacagtcacaccaactcaatactgctgggcccgtcacacggtgggcaggcaacggatggcagtcactggctgtgggtctgcagaggtgggatccaagct

SEQ ID NO: 83 - DNA, 1680 bp, homo sapiens
  sequence of T17
ggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcagcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaagtaagtgcaaaagaaattgccccctgatttattgctgaaacctgtaaggctcgaatgtgcaaaactgatagttttactaacctataaaaacgtctagacgcctacccaagcctaggcgaacaacatgcatccataaaaagagcttcccataaccacctaccctgggcgctcagttagtacggtaaacagagcgcgagcattaaggctttttatgataattccccacaagttgtgaaaagcgaccatccttggtgaaattaatttaacgacctctcttccccaccctgtggtctctccctgcctcccctcctctcctctctccccgtctccaaacctccctctttgtagacaaccccgccgcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttctttttttttttctttttagatagaagtgactgtgtggttggtctctgaggtatttgggggactctgtatttgctcgtttacgtgttggaaaaaccaagtggctttggggtttcgccctatcccactccctctctttcctgctccattggttccttaagaaatgctatattttgtgagtgcaagctggcttggggagccctctcttgtgtaaatgtcccccatgtttctgaaaagtgctgtagtttagtcccctcacccccagcactgcccaaacaggggccaagtgcgccccaattccaagaatgaaggcagagcgacaacagtgcggacaccccggctgctagcccacggtgaagcccggcggggttgcccaccagttgcgaaagccccctttcctcagggagcacgcgggacctcggtggagatctccagtgaggcttagaggagcccagggcctcgggcgggttggggtttgtcctcagtgcattggacgcgctgctctctcccctgaaggctgggctcgcgtgggcggccgcgggtggtggccctcccggttcctgcccgaggaccagttgtaaatgttactgcttcctactaataaatgctgacctgatca

SEQ ID NO: 84 - DNA, 919 bp, homo sapiens
  sequence of T18
gatcatctactaggttgaaaggagagaatatgacttccagaacagcactgatgcttaaaaaggatgcctctggaagaaaaggaggaagaggagcaagtgatgggagaatacagtgggactttgggcaccatagggtcatcctgagtttttcaccaaaatcaggaacagcggcaaaactggtttcactgaagaagacacacgtttggagacatgtgtagtctccaaggattctcacttaacaaagcctatttctgttgttaaaaacccctgcataatgcacccacacacaaacacaaggcttggtctgtgttcctggccacctaaagaaactgattcccagtaagtttaaacctgaatgaaatgtttctgcaaattcagcctcaaaattcctcctctacctggcatccctggcttgtaaactatgtgtctcattagttcataaacaaagcagccctgactttgccttgtactcaaccacagccctaggagccagtagaatttgtccagaggtgctgggctttggagcccaagtggacaaagtcagaccccctttcctcagggcaaagccctcccacagggctgggaccccaaaggctatgctggaagcaggttcagcagcaggatatcaaggggcaaagctcctaattcaaaatcttcctggcttctgaacaaccattaggatggacagagaaaacttttgccctgctctgagagggtcccacagggcttttggaagcagagccaccattgagaaatccctttcaacctgagtagtaattcagatttttctcccactcctgcacaacttaatttgctgaatggaaaattcagccagaagtgatgggctgcttgaaatcaacaaaacttgacacattcttcccattttcattttactttattgttaaacacataattgatc

SEQ ID NO: 85 - DNA, 1174 bp, arabidopsis thaliana
  sequence of STAR A1
gatcaatagaagaatggagtttgtgtttgctagccatagttttgacgtgtgggagagttggagtctagaaggttctctggacgaatgtcggcttgttaactgcaggaattcctctgtaagtctctgtccttacagaaaatggcccgaaattgaaaaaccctacttcttggaaaacagaaataatttgtgtaatgaatgttgcaggcggtgttggacgttcgtgtggagatattggcaatggtaggagacgatggtatcacacgttggatcgattaaaaagaaaaacagagtctctccatttgtgagtttctctcttttaattacttttgttactttaacatccttaggattcacagacgaaaaacagagacacccaatttttgtgtttcgagactgtgtcgtgtgttgtgtagttggtatcaaccaacttatatctgtaatcattgtttctttttatttattctcggtttgcagaaacatccgatgagcttgtcttagagggacgtttgttgttgttttctgggtctggtcgtgatgaactcgaaagcattgtgtgtttggttagtagtttgaaataggtgtgtgtattgtatttgtatatgctgcgtttgtgttttagagatcatcgtacataaaacacatcatcgtacataactaaaatttgagctaaactacaaaagaaagtaaccttcatttttagtcgaaccaggccccagctaggcagctatctcgtaaataagattgctggcttacgatcgtattccacgtggcaatttatgtgccgtggatttaaatttgtacgtggcatgagtgttaggagaatgtccacatggcttgtagttgttagtcccacgctctgaaccagagcaaccggctccttacacgtgttcggcttaaatccatttttcgaatgagattacacttctaaccttgtctccctctcccgcttataccaccaccactctcacacaagtctctcaagtcacaaactctgtttcaaaccaaaagggaactttgtgtgtgttgtcgagttttatggtgactgtaaaccctagccaagctcattgtttgcctatgaaaatgagtctaccgggtttcaatactcttccccacacggcaacaacgataccggtttccatacggagcaataggacgatgtcgttttttgaggatc

SEQ ID NO: 86 - DNA, 910 bp, arabidopsis thaliana
  sequence of STAR A2
gatcaaaattttggtttcttcgctttgattttcttcttcttcttcttcttcttccctcaagttccttagaatatctttctcatccattttttttggttcttgttttgttaagtgaacattttagttgattttaaagtgctaaacttaaatgcagcattttactaatataaaattacgctccattattgaccttatatacatagaacaaaataatgttataatcttcgacttttttctaacaaatattaaccaatcatgtcactaagaaattaaaaaatactagtatataggaatctagtccattgtatatatcgtaaacatggacacttcaccaacgaacatgcatggggtctttttataaggttctttataccgaaaccattgttttggtttttatgataattgagttagttttgtggcttttccgttcaactaaaagtctcattatgtcaactgctattaaaccggcgcacatggcatgttttatgaaattaaggtcaattggactccaacttttcaattattaaaaaaaaagaaaaatgattgttgtatgccttggcgaagaagaaaagccgctagctttattcattatcaaacgaaacaaaaacaacaacacatcactaagaatcttaaactcttaaccttacatcaaagtaacttttattacattgcatacaagaaaagaacaaaccagcattattaggtttgagattaaacctgttcccacacatatacatagagatatgaactctacaatttcaaaccagagccttgaagtttctcctcaacaatcatgtcgattttgttttccatttcaggagtcatataactcttccaatcaccaacttcccctttacggaaaaaactcttgaaacttactccttccgacaagcttcctgttttgttgatc

SEQ ID NO: 87 - DNA, 906 bp, arabidopsis thaliana
  sequence of STAR A3
gatcattaatcgcagatttttacaagacagcagcttggagagcaacttacaagtgtgttataaactctgaactcaacttggaagatgttgacgttccaaatgaaattggaagacaaactatcttcccaccaaggacaagaaggccgtctgggaggccaaaaaggctacgtatcaaatccattggcgaatatccggttcgtatttgtaggagtcccattttttcgactttatctttattccgtatttaattttcaattttatgtggtttaacagaaatcaaagagcgtgaaggtgaagattaacaggtgtggcagatgcaaaaagactggacacaacaggacaagctgtagtaatccaatctgaagatgttttaaaatcggctatattgatagaacgatgaccattttattattgtttttgtgtttggaaatggttatttttggataaaatatgttgcattctattttataattttagtttcgacttattacatataaatctagtaaggtaatatattagcaaattacagataatgatgaaaaacatggacaggtataggtggataagatataaataaggtaggactgaattgttacccgttaataatgaaagaatatacgaaatactaaacattaaataaggaagttactaattattggacaacaaaaagtttaattcctttaaaaagaaattggaatacagacagtttcattgacctaattaagtacttctttgaaaaaaatcaaactaggagaatagaagttgtaaataattgaagggaaacgtcgattcggtgaaaaggttttttaattagtatttaaagggaaatatcttctcttatacagaatatcttgccccagaacaaatcgcctcaaatactaaaagtgtgtacatcttctcttgatc

SEQ ID NO: 88 - DNA, 782 bp, arabidopsis thaliana
  sequence of STAR A4
gatcaaattcatatgcttatttgtgattatactttgctttgattcaggaaatcaaagaagatagctccaccttacagggtgatactacacaatgacaacttcaacaagagggaatatgtggttcaggtgttgatgaaggtaatacccggcatgactgtagacaacgcggttaacattatgcaagaagctcatatcaacggtttggcagttgtgattgtttgtgctcaggctgatgcagagcaacactgtatgcagctgcgcggtaacggccttctcagttctgttgaacctgatggtggaggctgctgaaactaattaaactcagtatagattttcccaccttccaggactctctatttagtcaaaaacatttgttgttttaatgtatataatatcagaaatttggtacaagactgttactatatgcaatgaaccttgcccctacatagatctgttgtgagttttaagtgttttcatttggaacttcagaatgcaaataaacaaaactttattgaagtcaaatggtgttacagatgaatctttctgattctgtaatcactaatgtaaatgtatctaagcaattgtaagggagtgacgtgtttcggtttcatctcgcccaaaaaagcattcaaacccaagaaacctgcagtttcaagacattgatgggataccatatagatgtatcaagcatcaaccggagtaagaagcgactgaatgccgaagataatgaaaagcattccaccggaaagagccacctgcaacaacataagagctatttgatc

SEQ ID NO: 89 - DNA, 1356 bp, arabidopsis thaliana
  sequence of STAR A5
gatcctgtaaaacataaagttagagataattgtccgatttgtttgcccttttaatttggagagatatgaaccaaaaacatatttcggaatgggtccctttttcatcgtgtgtaacagttttaccaaacagtaatactttgtgaaagttttgattaattaatgcaaaaagattagaaaaaagcgaaactaatttttggattacactagaaaaaggttaaaatcaataaccaaaaaaagaaaaaggttaaagttacaaaacacaccggtttatagagtgaaatgattattgttctgttgaattgacgtgccagcttagcatcaccttactattatcagtcacctatatatcacaattcacaggcttcttgctttctctcattggctcgtcttcttccctttcttctccaatcaccttagcttgctgatcaggtaaactagattggtgtttcgtgttgttttcttctcaacttaggtgtttgatttgagaagtttttctatgtatgttggcatgttgcgttcgtagcattgcatatcaacggataggtttgaataggtagaattaatttgattgatatatgaaagaatgtttgtatatatactctaggtctaggttattgaatattgagaaatttattttgttaggtttagatgaattattcttcgatgagtggttcaaagttcaattggcaagtcttttcaatgattgtagtattttggtgatgataagtaagttgttaatgactctcaagtctgaattcatgttttggttttgtttccttgtaaaaatgtgaacgtttttcttacagaagctttcacaaacaaagtatggttaattgagtgactaatccactaattctcttttgttgttttatatcgtttattaggtaatgttttttttttttgggtgtgtaaaatatgatactgactcaagattttatcatatttctgaatccataagctaaagtacatttgagagaagcaagagagatagaatggggcgtggagttagtgcaggtggaggacaaagttctttgggatatctttttgggagcggagaggctccaaagctagcagccgttaacaaaactccagctgaaactgagtcttctgctcatgctccacctactcaagctgctgctgcaaacgctgttgatagcatcaaacaagttcctgctggtctcaatagcaactctgcaaacaattacatgcgtgcagaaggacaaaacacaggcaatttcatcacggtatgtctttaattctttcgctgaatcgagtcctgtgtgctggttatcggatagcaaaaacatctgtatctttacttttcttagattagttgtctgaaaatgaaagaagatc

SEQ ID NO: 90 - DNA, 1452 bp, arabidopsis thaliana
  sequence of STAR A6
gatcgactggtacaatgctagaagccctagaggttgtaggtgatagccacgatacatccttaggtgatgtaagtcaactgaatataaatggccatttacgtagacttcatgtcctagatgatccctcctattataacgtgaatctcggtttcttggtgtggaaaacgaaatgattgatatgtttttgtcagggatttgaggtggtgaacagtcgttatatgactagttatgatgatgaagatacaccgccaggaagtggattcaggacaaaactaagagagttccataagaggtaaatgacgcattaactcatgcctctcaacattttgtcggcattcaaacagatgcattcaagtctcttttaataaacacaagaatcccatttgtttattgttttgtttgtatgcagtgcggcatcattcacagaactagataggaattacctaacaccgttcttcacaagtaacaacggagattatgatgatgagggtaacatggagcaacaccatggtaacaacataattctctgatctcttgtttcactattatttttgttgttattccgcacccaaaaccatgaaatttacaattggggttattgcagaagaacgaatcccatttactagaagaggaaatctaaataaccgcggctaagtttccgagatgagaaatctaatagtgttttttcagcggcatatatatgtacataaaacaaactggatgtatgggaggaggtagtgacaaaggatttgttctaagctaggtttctctataatatggtactgtgttgttggtgtaaacctgaatggatattgttaggttgaaactaattacattcacacaaagaaagaaaaaaacttgaagaaggccatggctggtttatactgaaccacgaattttgttagttttaaactcttagggaaaatgctataatgccttttttgtcttgtagtcgtgtttggtttgaattaaaaaaaaaatagagaacgtcacggcacgccaaaagtgtggaccttgtttattcgccggaagtaagtaaccaaaaacgcttctaatctttcgtttacaacaaatatctctctctctctcgctctctctcgctctctctttcttcttcttcatcttctttcatggctgttactggctgggcaatcacaatctgaattctttcttcctccttgtctctctgattttcgccgagttttgggggctcttgttgttacacgatgagtctggtggttggtcagtctctgggtttaactctagtcggtgatggtctttcgttacgcaattccaaaataaatgtcggaaaatcaaagtttttctcggtaaatcggaggagattggcgcgtgcggccctggtacaagctaggcctaaggaagacggagcggcggcaagtccttccccatcgtcgagaccggcgtcagttgtgcagtaccgacgagctgatc

SEQ ID NO: 91 - DNA, 1085 bp, arabidopsis thaliana
  sequence of STAR A7
gatctatcttatattgttagttcatgtttgtttttaaagactgtttttatgtttcaatggtatattactgactggggcagtaatattgttgaagtctgtagattatggtcgcatggctgaaatactggtgcagagggctgcttctcctgatgaattcactcgattaacagccatcacgtgggtaagcagaataaaccatgcttctgcttggcgtcttccagttatatagattggtactattttgacttctcgggagattcatatactaagaatatctgctttttattaaatgttgtagataaacgagttcgtaaaacttgggggagaccagctcgtgcgttattatgctgacattcttggggctatcttgccttgcatatctgacaaagaagagaaaatcagggtggtaagtttgcttctcctcctcagtgatggaaactgtaggttttgtatgcatctttttactttctttgttttttgatttttatttgcataaggttgctcgtgaaaccaatgaagaacttcgttcaatccatgttgaaccctcagatggttttgatgttggcgcaattctctctgttgcaaggaggttagtttttctctattgttgtttttatatccgtttgaatattattaaatcgcgcctgtttatttgtgagtttttgcattgagcaggcagctatcaagtgagtttgaggctactcggattgaagcattgaattggatatcaacacttttaaacaagcatcgtactgaggtgaagaaactggtttttgcttgggcatcattcttttctagttagcctttttgtttatcgcgttatagctaaattggtaatgctgcaacaggtcttgtgcttcctgaatgacatatttgacacccttctaaaagcactatctgattcttctgatgacgtaagttctatctccctgactgttcgtttgattggttggtgaactttataatataaaggtttggttttgtctagtaataaacttatttgatatttgaactatctggacttggaaatatactttaggtggtgctcttggttctggaggttcatgctggtgtagcaaaagatc

SEQ ID NO: 92 - DNA, 696 bp, arabidopsis thaliana
  sequence of STAR A8
gatcatctttttctaggtagggaattgcttatctcggtaagctaagaatgttagaaacaaagaactaggacagaacgggaaatggagaaggaggttagaatcaaagaacagtaaatggagaaggaggttaatgtgtatttcattctatctacattttaactaattgagtgtatccagtcttatccattaatgtaattacaagaagaatagtaccaagcatgtaggttatagttttcactttactgggtgaaggtttctgtagttcaagtgggtcaaaagtggtttgcggaaacatatctctaataatttgattgagaggctcctcgcactcacatggacttaaacttttgtgtattatacaaacatgattcacatacacatctcgtgtatattgcaatacatttggtaaattatctgaaaataataatgaaggtttcttcaaaagaggtccaggagctatttccattaacactgttatactgaacagtatacaaaagaagactgcagtgcgagaatttatggaggatgataatgcatttgagatattcttctgaacactttcatatcttttatgtaaaacatttttgatgagaaaatcaccagtagtatccaaacactttaatccagatgatgggaaaatgctttgtttaaacctactacgaagtatgcttaatacttcattattaccagttgatc

SEQ ID NO: 93 - DNA, 925 bp, arabidopsis thaliana
  sequence of STAR A9
gatctggtttcggtaattgttgtttccgggaattgagtatagaaacacaaatacatatttaaccctgatgaaagagggtgtaaacttgtgcagatagatgcgaaaacaacgcacgacaaacttgtgaagttggtgctcgatgataaagttagacgaaatgttgtatctcttattgttttgcgacaaatttacatgtcacggctgagttatatgcttaagggaagatgaaaagttcagtcaatttacatgtcaccactgagttatacgttccaggaaagacgaaaggttcgatagaattacattacggttgagttatatgcttaagggagaacgaaacgttcagtcaatttacatgtcacggctgagttatatgttccagggaagacgaaaggttcggtaaaattacattacggatgagttatatgtttaagggaagacatctataaatttacatgtcacggctgagttatatgttcaagggcaaacgaaagatgagtgtaaattatatgttacggctgagttatatgcttcaaggaagacgaaaggttcggtaaattacatgtcacggctgagttatcattcagggaagacgaaaggttgtgtaaattatatgttacggctgaggtacatcacgttaaggctgagttataatacagatcggaaaacaacatttttctggggaagacaatatgaaatttattggccaaagaacaacaatcaaattaagaaacgtaagaatatgtttgagggatacataggaggaagacgaaactatatgaatcaaaacattgatagaagtagaaatatctctaaatagatcgattgagaggaaaactaaacgagagacatataaaatcaaagtaaaagagtagttattcttgattcaactcaaacctgtaacaaatcatataaaattctatagatc

SEQ ID NO: 94 - DNA, 1753 bp, arabidopsis thaliana
  sequence of STAR A10
gatctgaatgagatgtgttggcgaacgcatatagtttttgtttcttgctgttcataactttgcttatggaattttatttatgtctttctctatacctctttggaccagtgttccatttgcaatagagagtcactcgtgaaaaaaacaaataatgtgtgtgtatcaattattccctctcggccttatattttgtcttctttttgctaattatatactattgatttagatatttacttatattcatgacgtcttcttcttatattcttatttaatttgaagttagaaaattaacgttacaacttacaactattaaattattgttaattggttttataataagtatcgctcttgtctccattcacttgtcttttattgtccccagtaccaaactaccaaatacaattcatattcactaattaattagtttgatgcaaaggatgatgcaatgttaagaaaattgaaactctaccacattctaaaatgaagcaactctaccatatttaatttctttagacttggaatagtcacaatatgaatgcttaggtagttacggttagttaggagtatcacacagaattgaaaataccaaaccacaattttaatcaggtgattcggtactaatttttattaatgaataaaaacataaccgaaccaactcaaagcagatattaacctgaaaatgaactcaccaaaacaataatagaaagactcaaatcgagccggaaaccagattgagcaacgaactcatgggaatatcatatctatttatgtccagactattaatatacatacctatgacaaaatactatgcatgcaatgcaagactgaagtaaccatatttttttgggtaaaccattgataagctaaacttgaatatccatagtacttcatcgtactatgtatcaatagtatagtaagtttgacacaattacattcagtttgatttttatcatataaacctcccaacaatatttaaaaccgtatctatatataaatttatttgattaaatcagcctagaagtttatagttcagtgcagataaattcaaattttgatatatatcttaattgaattaaccgtcttttggttaaattattgttacaagcttacaaaatccactatacaccaagttggacttagatatcatatatgagattaacagccgattacacttgtacattgacctgacctatacaaacgactacaactttatgtatatatatttctctatttttggaaactcgtttgatttgttttcacatgtcgtgaaatttacagctttgtttcctactctcaaaaatagagcatagagctggctgatcacacttcaaattaaaaccaacaacgtatataaactataacccatgtgaacacaaaaatttagaccttttttcaaaaccattccaatttctaacaaaaacaaaattagaaatcctaaaatctgcaaggtgtatggaaggcaaaaaaggctaacaggattaaaaacagtttacattagttattctctttaaaatagaaagaagattttcgataaaaacgtcgtcgtatcttcgtcgacgtctccgtctttaatgggggagcaaagggcaagcggtgcttcctcctccaccgactcatattcaactccttcgccgtctgcgtcaccgtctccatctccggctccacgtcaacatgtcacgttactcgaaccatctcatcaacacaagaagaaaagcaaaaaagtcttccgagtttttcgttcggttttccgatc

SEQ ID NO: 95 - DNA, 1908 bp, arabidopsis thaliana
  sequence of STAR A11
gatctcactcaagctcatgctcacgttcaaggactttccaaccgcaaggttatcttcaacttgtactcattaaggcctctcaatattcatgtgttatgttcatgtagatgtccggtccagttcaacaactgtttcattgctttagttgtcacgagaaatatttgtatatattattatggtgtgcaaaacatagtaaaatgttgttcaattggcagatgatgatgatgaaaatggaaagtgaatgggttggagcaaatggagaagcagagaaggcaaagacgaagggtttaggactacatgaagagttaaggactgttccttcgggacctgacccgttgcaccatcatgtgaacccaccaagacagccaagaaacaactttcagctcccttgacctaatctcttgttgctttaaattatttcatattgtaaattactttctgctttatcggttttaccatttcgggagtcttttttgtgtgcaatctgtttcgtttggtaagcttgtagtttcatgaaagtgaatgtaagatatgcattacgtttgttgctgaagtgaatgtaagatacgcactattatatctcatgattttctaagaaaaccctcttaaaacgaagatgtctatagcattacgtttctatttccatataatacgttaaaatttatggtttttacgtataaaatgcaaaataaagacacaagtatatctccaaagcaatgtaccgttgggaaaatttattagtacgttttcaattgtcaatgcaaataattaatggatgtgatagtcacaattaaacatacaataataaaaatgatgatgatgattcgatgatgtggtgggaaggataaattaaaccgactttggggcagtgacaggcagtgtcagtgtcaaagacaaccatttgtagtcactatttctatcgaaggttgcaaattgaatggtggaggagtatcaaaacgacacacatacttgaaaagatattttaataatataaaaaaattggtgatggcgtaataacaaacctagagctaattattatccttaatgataccaaatctatatgatacgatatttgttttaaaaagagtaaagactgacacttgagatgtgacactggcgatttcgctcacgtcaccacttttcccacctcaaataacgcttacggctttatccattaattctaagtataattttaagtgtattttttcttgccaaattcaaatatatcttactaaatggatgaacattataaaattgttatcaaaaccattaaatgttcttataatttctttcgttcctccaatgtcatcccaagactttttgacctaatatatgatatatctaacttgctttggaatcgtatgacatatatcttcaaatacatatttcgtatttttttttcacgaaaactaatttagaaagtagaaaaccagctattttaaagaaaataaagtgtgtttatatatattctaaaacaatgctataagaacataagaccaagatatatacaatgttattttatatttattattaagcattaacattgaaattaaaaatattaaacatgtataccaaagtaatcaacattgtagttattactactctctctgttcatttttgtttgattgtttagaaaaaacacacatattaagaaaacatattaaatattgattataaatgtattatttttaatgttttacagttttctataactttaaaccaatgataattaactatttttttaaaaaattaccattcacctatactaaccaataaagattacatagaaaactaaaaaaattaatcttttaaaaacaaattttttttctaaacaatcaaacaaaaaggaacagagggggaatattattttaatttaatttagattaccattgtagttagtaattgatc

SEQ ID NO: 96 - DNA, 1403 bp, arabidopsis thaliana
  sequence of STAR A12
gatctattgctgtttatggcaggctgtcatttcagaaaagaatggtggtttgggatgtaatgttggtgaagatggtggtcttgctccagatatctcgaggtacatatatttttcctctctgatgctaatctgcttgcatctgtagattgtcgaaactgagaaaaccatgttatggtttgatggcttagtgcctaatatgtgtaattgcaactgtatgcagcctcaaggaaggtttggagcttgtaaaagaagctatcaaccgaacagggtacaatgataagataaagatagccattgatattgccgccactaatttttgtttaggtaattttctgcttcctggctaactgattttttgcggcttcttgtagtcatggatagtcttggtttggttctcggcattgtcattcacaattggctagtgagacgaataagatgttaaatcatcaaatgtgtagcctatcaatatcttgctcttgcaagtttcaactatgttatacgtttttgtgtattatttcttaccttgtggaactgttctttcctgaacaggtaccaagtatgatttagatatcaagtctccaaataaatctgggcaaaatttcaagtcagcggaagatatgatagatatgtacaaagaaatttgtaatggtatgtctggctcgtctgaacaatattttttgtgtctatcttagtactcttgcagtattgtaacgaccagattctctgtttggtctccttgtgggtttagattatccaattgtgtctatagaagacccttttgacaaggaggactgggaacacaccaagtatttttcgagtcttggaatatgtcaggtccaactcggttcccctactattaacggttcacatagattttgtgttctttcagatcacactgtcttctgattcttttctcagagtcaaatatctaaagagagagacccttaaatcttcttgtacaatcattttccttgtctaaattctcagtgttaaactcttgtaggtggtaggtgacgatttgttgatgtcaaattcaaaacgagttgagcgtgccatacaggagtcttcttgtaatgctcttcttctcaaggtatttcgtccgtcctattttgtttattactatgtattacctgtgcacatattgtatgtttactgcctaagaacgacaaagacataatgtgcatacggtgatacaggtgaatcagattggtacagtaacagaagccattgaagtagtgaaaatggcaagggatgcccagtggggtgtggtgacatctcatagatgtggagaaacagaggactctttcatctctgacttatctgtgggtctcgcaacaggtgtgattaaagctggtgctccttgcagaggagaacgtactatgaagtataaccaggtctggatc

SEQ ID NO: 97 - DNA, 1140 bp, arabidopsis thaliana
  sequence of STAR A13
gatccatttcatatacatattaccaattttggcttttataggtttgtatccagaaggccttttcgtggctacgattaaggaaaatacgaaaacaaaagtgaattttactacttttgtagcatggtttattctactttatatacctaagaaatatgagcaacaattacttctgtaatgactttttactacttcgtagttggtacaaactacaaaagattgtgttgtttttacatgatactttataatatctatattaatatatttagtcgtgtttaatcaaaaaagcaccagtggtctagtggtagaatagtaccctgccacggtacagacccgggttcgattcccggctggtgcattgagctatgatgatataggcttcagcattggttgggtccattgcattcttctgaactatcagttgatgtatgccacacctctgagctcttctttttttttcctcgtcaattaattttttaaagttttgtctgcctaaaaactttcttctttttgattaatcatattaagcatctcggctataaaaaccacggtctactaacttaacatgcattggactagttttagtggagagtgttcgagttaaaatgagaagctcacgattgcataacggaacatttgattcgctaggcatctccatttgtaaaagtagccactccaatacaaaatggtcgatgatggtgagtgggtgagacaaacccaccaccacctcaagaagatatatttctctggttaagaatttgaatggttgacaaagaaacggtcactctatatacttagaaaatatagtcatacatagacaccatcggtctagttataataataaccactggattaatgcccagtgaaaataattgagtagccaaaacatgaatataacaatatcccaatttacatacaacaacacaaaggaggttttacacgattctatagtacaaactcataacaacaaaaaatcacacttttgtttaacagttgcctttatggctttactacagtatcttgtccagggttttcacacataacaatcacagtaaatcgtttccttttctttgcatcttccattccttttgtacacgtaacatctccggcttcccgaccatcagctaagaaccagatgcgatc

SEQ ID NO: 98 - DNA, 2125 bp, arabidopsis thaliana
  sequence of STAR A14
gatccagcaactaagtcttatgctcaagtgtttgctccccaccatggatgggctatacggaaagctgtttctcttgggatgtatgctcttcccacaagggctcacctacttaatatgctcaaagaggatggtgagttcatcaactagttaatatgctcaaagtggatggtgtgtttgataaactagtagtttaagtagtcagattagtttcaaggtcttcacaggattaggtagatatcacggcaatatttggcctgtataagtcctggtatcataagagagaactctttgagattcacattggttttaagttcatttggcagtaggatattagattttgaattttccaatactatctctgtttgagatttcataaatcgagtttcttcttcattatgttcgctgacgatattgtttttttcatttatttatgaatgttgttacagaggcggcggctaagatacatatgcaaagctatgtcaattcatcggcaccattaatcacgtatcttgataatctattcctctccaagcaactcggtattgattggtgaagagcctgaaaaaaaggcataactattgttactctttagacaaaataacctatgttctcacatcaagctatgtaatgtcataacaacagcgacgaaatacattggaataaattgagtatgtccttaatctgtcgttttatctcttcttttaataaacacagtttatctcatagtaagcagaagaagctttacacgggttgtaggaacgtattaaacggtttgtttcaatttcactctctttggttttgaaattctagtataaaccaaagtagttggtgcttcaagttgtgttacttattcaacaaaaaaatatattatttttaatttttaattttcgtaggtaagattacatagtaacaaaatgttaaatttaacaatgtaagattactatgtaaatgcatgggcaccagtaatcacgtatcttgatgatatatatccctaatccaagcgagtcggcatttattggtgaagaatctcaagactcatagtcatcgctagttaacaatctttttcggacaaaagcgtcttcgttaaaattcggcattattaacctttttgcccttttaaaatcagaaaatttctgttttactggtatttttctttgacgattcaattttttagttgtattatatatatgaaagaagcttaactctctctcacagcttgatatgtcagtatctaaaacaagcaatacataatttaattaatttatcataaaatatttatgattaaaaagtaaagaagataaatattaaaaagctaaatgtctcttataatttaaaaataaaaattaaaaaggattgaaaagtaaagaagataaatataaagaaactattagtatcttataaataaataaataaactaaaaattgaaatataattattttagttttgaattaagaaaatattaaatataaaaaaaattaaacataaagaaactatatatatcttgtaattaaaaaattaaaaaaaaatgaaaaatgagaaaaaaaatataaactcttcatcatataattaatgaaatttaaaaacttattgcttttaattttttgtacaataattaaggaaatttagaaattaattattaattttagaagaaaaatgttaaaatagtttaatagttttgattcactaaatacatgtgtacatatatgatggtatgaggatcaagaaagtgccgtaaaatgtaaaacttccaatgttccttagtgaaaaatgttaacttttctgttgacaagacgtgtatataaacatcacctataccggagaagaagaagacacaaaacaaagttaaaaagaagaaatttttggtgcagtgaattcgaagagcaatatgaagaatattggttacattattatagccaccttgcttgttggtctcctcctcatcatggctctagtggcgagtttctattgggccaaacgacatgtcaaatgttgtggcggagagggactgtcgtcaaaggatgtgttcaatttacttatacaattggttgcttttattctgctttgtggtttatttgcttatttggtatttttggtttagattagtaacctaaagccatagcagatc

SEQ ID NO: 99 - DNA, 1196 bp, arabidopsis thaliana
  sequence of STAR A15
gatcagcaattacagttggatggaaaaagagagacgagaatgtatctgctgctggtgactttaaggtaggctgagtaccaaattgcattctgactgttcttacctcgaccacctttcttactttccctagctctaatcttgctattactagattgaatctggtggactcggagcatcagctcgttatactcgtaaactttcatccaaatctcatggtcgcattgtgggtagaatcggaaggtatgttttattgacaatcccgagcaacctaatgtatgatgtgcgagaggatagaaatcattttttaagttgtctttacatgtgtggcgcaatcattgttctcattttactttggaattttttttttaacttattcagcaatgctcttgagattgagctcggtggtggaaggcaaatttctgagttcagtacagtaagaatgatgtatacagtaggactcaaggtaaactactctttaaaactttcggagccatcttagccattatgcaatctgcttatttccggtactcttatactttgtttgtagggtattttctggaaagtagagctacaccgtggtagccaaaagctgattgttcccgtgagtgttactttcttcctttcttttcttgtggtgtcatgtctgctgtcttcggataagaaccgaacagattgtgtcttaatctgtggagtagaatatattaaaaaagcataaaccaatagaaccaaagaccaatcctaaaagcctagggatggattctagagcattatccttgactctctgaaacctttacccaactcaattatggacaaagacaaacatccgtattactctggggaagtctttcacttttgacaccttcatgatgattatctttgaaacgtgcagattctactctccgcacatttagctccagtatttgcaactggagcattcattgttccaacatctctttactttttgttaaaggtgagtgattggaccctctaaatataatctacttttggtctattgttataagctgtttaccttattaaacattttcactgttccacgcagaaatttgtggtgaagccatatttgcttaaaagagaaaaacaaaaggccttggagaatatggagaaaacttggggccaggtgattgttacttccgagtttggtagccaagcgagattccttgtaattgtagatgatc

SEQ ID NO: 100 - DNA, 692 bp, arabidopsis thaliana
  sequence of STAR A16
gatcgctttcagtctatcatgttttgagccttattttgggagcgatgtattaatattttgcctgttctttattttttgtgttgcagacatacaatgaagtgcagcggtgttttctgactgttggcttggtttaccctgaggatttgtttacatttcttcttaacgtaaggacatcttttgttttatgattatggctctagttattctttgtatatgtaacgcaaaacggtggcaatacctagcactcatattagactcaagaactattccttgccacacatctgtgtgatatttatatgggctttttatcttacatatttgaaatccctgtcttccttgtatactttcaccagaaatgcaagttgaaagaagaccctttgacgtttggtgctctttgcatcttgaaacatctgcttccgaggtgtattcttttatccttcatcagtataacttatcattcagagttaatttaccatcctaacttaatgatgttgcattgtgttcgaaggttgtttgaagcatggcactcaaaacggcctcttttggtggatactgcaagttctttgttagatgagcaaagtttagctgttcgaaaagccctttcagaggtactgagctggcgtagattttcttatttactactaaaatatgcatgctttagcatagtgcttctactttaatgacagttgatc

SEQ ID NO: 101 - DNA, 1826 bp, arabidopsis thaliana
  sequence of STAR A17
gatcacgataattttccttaattatctaattctaagatagtctaaccatgaatattcttataatatcttaactgtataggagattctattttcatccctaaattatattcgtaattttattcggatatacttgcttttattttcgtcaacagatatatatatatatatatatatatattatttatttttaattttcattaaaattagtgatttaattctctattatttgtgtactatataaaacaaacaaatgaatcttataatgtttgctttttcgtccataaatatttccgggaaaaatcgttagatataaatcgaacctagtggtgagtgactcacacacatgtgacaattcccaaaataagtcccccacgtacgctatgtctgttttagtgtgcatgtagtaactattatttactgatttagaatataactagcatttggcccctatttagggataacattgttttagattatatctgttacaacttttaactaaaaattttaaaataaagcagacagtattaatatacaacaaatttattatcattgatcgaagaatatacaaagattaagaaaaagatataaagaaggtacaacttttctacccaatgaatcaattgcgataggcaataactaacaaatcaagagtttagaaatataagagagtataagtacgaaaattatgctgggtatatacatgtccgcttatttcatcattagctccaaccaattgtaatgtgttcttcttctcatcatcagtaattcagtttacaaacattcgttgacacccaaagcttggaagtctaaaaaaaaatgtaaaatgtgcacaaataagtaactacatgacgcagacgctgcctttgaaacaatatcaaagatattgcagatataaagaagtaaaataagagatgactttaaaattgaagtatttgtattaatacaaaaatcttgcgtgaaaatacaattgcagtttaatacaaaaaagaaattgcagatataaagaagtaaaataagagatgaaagaagaatagtaaaaagtatgagaattaatttaccatcaaaaaaacacttgagcttcgattaagatattaaactcacccttgttttaaggcaactgttcagatgagaagccaaaatttgtcgttgttccttgagtgtttgtgagacgggagaatcataggcattgattgtattaaagaataatcctatggaaaaatggagatgtatgagagaaatcgaattcagtcaaataaagcagaaacaaagcaaaaaaaaaaaaaaaccatagaaatctagaagaaggatatatgattttcggatctatggaaaatttctatatatataaaacaaaattacaaacagaaatagaagatggtaaattggttcattgagatgaacaaagtacctgatttctgagtaatcgattaatgatgttgagaaacccatttttgagattttacacagtagtcatggagtttttggaagagagaaagtggagatgtggagatcgtggggatgaaagagaaaatcatttgagaaagaaacaaagttaaataaaaacgacacatactatgcgtaaaaatgaaaaaataaaaaatagtactaagctgatgtgtcaatcactgaatgcattagttattggaaaagtgactgctgatttagtatatttagattagagaaaataaatacttgtaatcatttttcttattagcaatgttgaagtgaaaaaaaaaagaagaaaaaagtgtatatttatcatactcatagtgggaaattgataattcaaaattgctgataaacgttatgaaagaaggtggaggatc

SEQ ID NO: 102 - DNA, 1590 bp, arabidopsis thaliana
  sequence of STAR A18
gatctgttgattggttaaatcgacgatctcaacggcggaggaagtgacgatgaaggcgcggcagagaggacaattagagtgagatttcaaccaagtatcaatacaaggaacgtgaaacgcgtggttgcatttaggtaacaatctcaagctctcgttctcttgaaactcgcttaaacaaacagagcaatctgaagattcaacaaatccatccatctttctgtatttgtaaacagttatcgatttaatcagagattcatcgagtccatcgccaccaccaccaccaatcgtttgattcggattcgtagctccgttgttgttgttgttgttggttccttgccaggtgtaatctgatgagattctgtttatagctgcggcggaggtagaggaggagttgtggcgacggcggtggcagtatttggagatgagagtgtagtagctgacgaggatgaaggcgctagcgaggattccgatgagagcgatgaggagaggagagaaatcagaggaggaagagtcgtcttcgtcgtcgagatagaaggaaggaggaggagggaagatgacgtaacaccattgagggcaatagacactgcatactccttgagaacagtctctgtatgaatcgtatgttgtaccccatggattagggtttcctgttgaacccattatttgattgttggagaaagatagagagagagagcaaggaagaagatggaggtgtcaagtgtctctctcctttttctttgggctctgcttttgtctggtaagtgtctatttttttatttcgagttaattggtattattagaggagataatgaataaatatatatgttcatgaaagcttttgcatgatggtgttaatactaattgaatgatgtttatagtgaatgttctactttatcaaatttttatttctagtatgaataaaggtgtagaatttgctttattcatttttattctttagctttctctttatgcttccattttttttaaagataaattaatacattagtaaaataaatggagttcattttttttttttttgattttattttgagaaatgagaacgtaacataagaagtgttttagtgttgacgaaataaaaagagagagagggtttagtctatttcaaggcataaaaaaatggttggtgaagtgttgacgaaggtggaatactataacatgggccacgtggatgacaaatttactcctcgacgtatctattaaagttgtggtcagaaatacagtacaatttaccgactacctacatggaagaagaatattttcatttcatttcaactacagtagtataacattcacgttatacgatttttcatttttgttttgtaatcaaagtaatgattttccaaaaaaatcattgctatgattcgaatacatacagttttatattagtttacatatttatgacaactataatacaaaattttaatagttgttcaagggacgattgatgtgaactcgccaaccatatgccctacgtacaaaataacatatttacatgtagaagttgaaaataataataataaagtgtgattaaaaacaattatacaaatgctaacaataggctacgagatc

SEQ ID NO: 103 - DNA, 706 bp, arabidopsis thaliana
  sequence of STAR A19
gatcttgatgtgtgttttgtgtttttgttattgcaggatgtatgtttcatagtgagacagggcttaagagctttgaccatccgactaatatgatgaaggcaatgccgaggattgatagtgaaggtgttctttgtggagctagtttcaaagttgatgcttgttctaagatcaatagtatccctagaagaggaagtgaagctaactgggcgctggctaattctcgttgattttgcttctagtttcgttaactcttgcttctttgttgcgttttctttttatgtactcttgtttatgtaaatatagccttatgaagacgataaagaaataaaattgatttgcttcttcgtgacatagcagtctttacttagacaactgtgtgataaattcgcaatctcactctttgatagataagagggagggaagaaagcagtggtaaagacaaaactgtgttgattttgtgaatttagaagtttacaatagcaaaaaagaaactttggtcgacttttatcattcatcgttccacatgtctgtaaattcatcaggctccaatgggtttgagagttcatgcatctttcttcttgtttttgcctttattttcttagcaaatttcccagctttatttcttttctccaaagctcgaatctaaaaggcaggaaattggaatatatgagaactctgacagataatcatatatagcaatgtgatc

SEQ ID NO: 104 - DNA, 2064 bp, arabidopsis thaliana
  sequence of STAR A20
atcgtttcaaagcatggtctaatgatgatcctgatctccgactgatccaataacggttaagcaacgctgtttttgatcctccattgttgtttgccatcgatcaacactcagaaataaggtaattaacgcatctcgagactcattgttttaacaatctttgttttgtttcttccaaattattctcgtgaatatccgtaatctctccgtcttttaatgaacaacacatatcatatgcttttgtttgttttgttttgttttttcaacatttcaataattttgtctttttttcttcgatttaatttgtttatttcctgctataataaacgaaaactataattccatgtaatgttcgttgttgttcatagtgatttatcataacgagcaacaacataaaaatcaagagaataagaaattagagttatgctgcttatttgaattagacaaaacctacttttacttgttaaggaaatgaaaagatgttaataaagatgagcacatcgtacgtggcgcacgtggaagcacttctgtacgacggacccagtccaactcgaaccccacacacatagcaaaggttgttaagttggctcgtaggtgaatttaatacctgttatttcctttatagctggctaattacctaaattcgatccataataacacattcctactatgccaacatttaaccctagtcaaactaattaaaacgtttcttactttttggcctattaaaacgtttcattatgttccgcaaatagtatgaaatatataaagattttctaacaaaaaattactaagaacagttagactgattgagattgtttttatttccttttatttaattttcttttattatactctgtttatttgtgtttaataattaggattctatttgtcttgtcttgtttgctatagttggagttttgttcataaagaatggcgtttaatacggctatggcgtctacatctccagcggcggcaaatgacgttttaagagaacatattggcctccgtagatcgttgtccggtcaagatctcgtcttaaaaggcggtggtatacggagatcgagttccgacaatcacttgtgttgtcgctccggtaataataataatcgcattcttgctgtgtctgttcgtccggggatgaaaacgagtcgatctgtgggagtgttctcgtttcagatatcgagttctataatcccaagtccgataaaaacgttgctatttgaaacggacacgtctcaagacgagcaagagagcgatgagattgagattgagacagagccaaatctagatggagccaagaaggcaaattgggtcgagaggctgcttgagataaggagacagtggaagagagagcaaaaaacagagagtggaaacagtgacgttgcagaggaaagtgttgacgttacgtgtggttgtgaagaagaagaaggttgcattgcgaattacggatctgtaaatggtgattggggacgagaatcgttctctagattgcttgtgaaggtttcttggtctgaggctaaaaagctttctcagttagcttatttgtgtaacttggcttacacgatacctgagatcaagggtgaggatttgagaagaaactatgggttaaagtttgtgacatcttcattggaaaagaaagctaaagcagcgatacttagagagaaactagagcaagatccaacacatgtccctgttattacatccccggatttagaatccgagaagcagtctcaacgatcagcttcatcttctgcttctgcttacaagattgctgcttcagctgcgtcttacattcactcttgcaaagagtatgatctttcagaaccaatttataaatcagctgctgctgctcaggctgcagcgtctaccatgaccgcggtggttgctgcgggtgaggaggagaagctagaagcggcaagggagttacagtcgctacaatcatctccttgtgagtggtttgtttgtgatgatccaaacacatacactaggtgctttgtgattcaggtaatatgtgttcaaagttactactttcaagcaaatcctctgtttcctcacatcatgatc

SEQ ID NO: 105 - DNA, 1834 bp, arabidopsis thaliana
  sequence of STAR A21
gatcttcttctatatataccggtataagtcaactggcggctgaacaaaggtcgtgaggtaacaaaatatgagacaaatctacaggtcagattgggttctgaattctgataaggtcttaaaaaggagctcaccaacccacaaaaccatggattgaacaagtacaggtcattgccttcattttattctttacttttctaaggctcaagcttcctttattgcctttaataacaatatactaatgagtattttgcactcagtaacaaaattcaggagagtaattttttgccctaacatgttacttttatgtgttaagagtttagaattttggatctatgattttagtttttgttagggaatcatattcatataaataaaatattgccattgacttaattgttgttattcacctaatttctctccaaatttggtcatttacctcagttgattctatattatacttgctaagtgttctttgtctaattctctatcattgtttgatttaataataaccaaaccttaagacttggaagcaaagaagagagaaaatcccaattaatttttaataattcaaagagagatattgagtgacttccactaatacaaagaaagcttggtttgtgcaatattttgcggttaagctattaattgctgaggcaacaccttttcacactttgctttccttcttccaagttttcaacttttctttcttactctttctattaatcaaactgcaacacaaaaatcatttggataatacatgtttagaagatgattaagctttagttttatttcaagattatcataattgttatctgttgttacctacattcatataatcttatcaaaaacgataaagacaaaaaggggatacaatataggtttttattataaagaaacaggaaagaaagaaaagggttttcaccaaacgaaattagttcaatcatttaaattatctttatccttatgattagtgtctttatatctgtcatatgctgcttctccttccaacttcctttggattatattctcttctctttattttaatttccatttgtggtagctgttttattttttgtattttcacgccgtgtccctttaaaataatattaactacaccactaatgttggaacatgaaaaacatgaatgaggtaattatgatgatgaaccaaatgttaaggacaagctcggtgtaactaagaagataattagtgaaacagaacaagtcaataacttgtaagcatttcagaattgaaaataaagataagggaggatgaatatgaatttagtaaatgggtaatgaaagtgaaagaagaagagggaagggttggttactgtctcaagggtttgaaatggagacggttgcttgagaatgaggaaaaagagttagtaagtttttaactctctctttctctctccctctctctttttcaacgtcaattcctttaaggaatggcctctctctctctctgaaagtgtgtgtgtatatattaaacgactccatttctcctctgcttagaccaaaactcatcttctatactgcaacaaagaaggaggagccgttgagactacaaaatgactgcagcagaaaacccttttgtatctgacacctcttctctgcaaagccagcttaaaggttcttatttttctttctgtttattgttcatcaacccttatgagtaatttgcttgatgttgaggttgttctgctttcttttaattccactctgcagaaaaagagaaagagcttttggctgctaaagctgaagttgaggctttgagaacaaatgaagagctcaaagacagagtctttaaggaggtaacatgcatgatgatc

SEQ ID NO: 106 - DNA, 751 bp, arabidopsis thaliana
  sequence of STAR A22
gatccattaagaagcagccgcaaaatcggattgagaacaggaaaagaggcggttaaggcttatgatgaagtcgttgatgggatggttgaaaaccattgtgcccttagctattgttcaactaaggagcactcggagactcgtggtttgcgtgggagtgaagaaacttggttcgatttaagaaagagacgaaggagtaatgaagattctatgtgtcaagaagttgaaatgcagaagacggttactggagaagagacagtatgtgatgtgtttggtttgtttgagtttgaggatttgggaagtgattatttggagacgttattatcttctttttgacagaaatacattgaaaactaccgttgctaatttgataggtatacatatatagacatgtatatattgtataattatatgtcaagattatttatttattttacatttttcacaaaaaaaaacgttaatctatttttctgtcacaagtgtgtttttattcatactacatactacaacgccaatttaacatgccaaatataaaacatacatgggcaaaggcccaacagccagtttaaagaactttgtctgaagagaaagttgttgtatatatcacaagggatatgtggtaattgggaaacatgttgggttgacacgtgggaaattgaaggagatggagtttccgtcactggtagaatcttctaacactagagagcttcaattcaggttgaaatcgtcagaaaactaatgcagacggtagatc

SEQ ID NO: 107 - DNA, 653 bp, arabidopsis thaliana
  sequence of STAR A23
gatcaaaacttagtcaaatcgttccttccattttctttcagtttgattccactttaatggcgtcataatcatctcttaaatcaaacaatgactccactatctcgtttccgatctcttgttacataaagttttctgtagcattgagattgtccttttcggaattgcttttatttgcgcagcttgatggaaacaacaaacagtgtagtagtttagtagaaagactgagagataaaacgaagagtcaagttcctaagtccattacttgcattaaccgcttagagatatcgcgtatagcaccattacacgcaacgatgaatagcccgaaaggatttggacctcctcctaagaaaaccaagaagtcgaaaaagccaaaacccggaaaccaaagtgatgaagacgacgacgatgaagacgaagatgatgatgatgaagaagatgaacgtgagagaggtgtaattccagagatagtgaccaacagaatgataagcagaatgggatttacagtggggttaccactcttcattggtcttttgttcttcccattcttttactatctcaaagtgggattgaaagttgatgtgcctacatgggttccgtttattgtttcgttcgtcttctttggtacggctttagctggtgtgagctatgggatc

SEQ ID NO: 108 - DNA, 548 bp, arabidopsis thaliana
  sequence of STAR A24
gatcagactgaactcgtgtactctgagccttgcttcttgtagctcttttagctttcacattttcatcagtattcacatcattcctgataattgtgccagaagtcccacgactatcttgttgctcactaatggttgctgctgcagatgattccatgttgtcctcttgtgaaaccccaatgcttcgtctagcaactgtatttcttgcacttcctgctttgcggtttttacatttggatgatgcaactttaactttaggtagcttcttttgagtaagatcaatctcatctctacctaggacctgcaaatcgatgaaatttgagttcatttcaacacacttgatgacactatcatagaaaacaaaaagaccttgctgtaccagagtgaagaacagcctttaccttggccttcacaggactaggtagaatctccggagaacaaggcctctgagtccattcaaacatttcgctatcaaacatgtcacctggattgggcttttgttgctcgtcttcctgaaacattcatcggaaaaaaagtaagatcaaaggatc

SEQ ID NO: 109 - DNA, 1000 bp, arabidopsis thaliana
  sequence of STAR A25
gatccaaactctgcaatgtatattacgaagtcgtttgatataacacctctcttgataaaagatgattagaacctaaagtaattttaaaatatggtgaaaaattagactcttggagtatataaatggctcaatctgtattgcccgcaccgcccaaactcccatggcaaatccattgacgaaaccaaggtaaaaatcacatgctttgagcgtttttttaaaacagaagtgtaagcttaaattttttagtttaatagtagtaacaaattcaaccttgtgaagagatttattaataatattaaaatcattcccctaattatttgccttgagtttcgagccttctactgtaccactcacacattaaaaatcatcagactattcaaactttcttacatggttgattagttcatctcatatatgctcagtatcatactcttgcagattaatttttcattttaattatcaacgaattttttatttaattattcatgaccaaaatacatttattttttttaaataaaacaaataataaatttggaagtcaaaaatacaatcaatagaaaaaaaagtatgacagtgatagataatatttgcagaatattatgtgaaagctattttctctgtaacaataaatgagaaaatctttattattttacatgaaagaaaaagaaaacaaaacagagatatttttccagctgaaaagaacaaacatctctcattgatgttcagtgaacttgcaccaaacttcacttcttctatacttcttcatagccacaaactcagttctttgcaagaaacacaaacttaagtattcaaaatatcgtcatcatgttctcaagattccatgctctgtttcttctccttgttctttcagtaagaacatataaatgtgtatcttcatcttcttcttcttcttcttctttctcattctcttcattttcttcttcgtcttcttctcaaactcttgtcttgcctctaaagacccgaataaccccaacggatc

SEQ ID NO: 110 - DNA, 1926 bp, arabidopsis thaliana
  sequence of STAR A26
gatcctcgattcttatctggatacagaagaaaacacctttttgtcttttaagtactcggagaaatctgagggtatctttttcttgagcagatggaggtgaagtcctgagttggggaggagggggctctggaagacttggccacggtcaccagtccagtctttttggcatcttaagaagtaacaggtttgttttacttaatttcaatatcgttttgtctctttctcatgcattttttgctcacaagaattttcccatttcctcctttactttatcatgattccttcataattttcttgtattgcactgtaaagtatccccctgattgcagtgagtttactccaaggcttatcaaggaacttgaggggatcaaggtaatctagtggtgaagaatatccaccttggatgaagagtttctagttacctagtggtggttttaatctttagactttcatgcttatgtttttccattctttctgtcgagcactaggtcacaaatgttgctgctggtctgctgcattcagcatgcactgatggtattgatttactttcttaaaagtatgaatgttgtgccatttaccgaactttatgaggtttgtttgcaaatgcagagaatggctctgctttcatgttcggagagaaatctataaacaagatggtaagaaaatgtctttttctttgatttctgtggtcatatatgtgaagctatctgatgggaaaatacagggctttggaggagtaagaaatgccacaacaccatcgattatcagtgaagtaccatatgcagaagaagttgcatgtggtggctaccacacatgtgtagttacaagtaatactctcttattatatcgttctttctttgatattgagtttgcttgtatactgcaaatgcctgtcctgctcaaatttctttttgttattctttatagaggcccaaaactgctctttagtttctgctaaatttatgaacatattgtgtttgtaagatggtcgataacaactcatcgtttgatgtttccttcgtttttggaaggaggtggggagctttacacctggggctcaaacgaaaatgggtgccttggaacagagtaagttacataccccgaaaaaatagaatgtttccccataagatgaaaacaaggttcttgaactgtacctatactcttatttcaaaaaattcagttcaacgtatgtctcacactcccctgtgagagttgaaggtcctttcttggagtctactgtatctcaggtatcttgtgggtggaagcacactgcagctatttcaggtagcatctcttttgagtaaaacatatttgtttcctctctcattgtataagttaattcaactcaatttctgaaacttgtttgcagataacaatgtcttcacctggggctggggaggatctcacggcacattctctgttgatggacattcctctggtggacaattggtttgtttcatcatcttatcttattgatcaaatctctgaaacaacattttcaagtgtcgaagagaataaatatggtatgcttaatatgtagggccatggtagtgatgtagactatgcaagaccagcaatggtggacttgggaaagaatgtaagagcagtgcatatatcttgtggcttcaatcatacagcagcagttcttgaacatttttgaagactcggtctcaagttaatatcatatacagatgtttagtttattcttgcttaaacatctatagactaaaaaaataataagaaatttacactattgaatagcgatcaattacaccattggttctaacttgaacaatttagtaaataggtggaatattcttgtcgtgtaaattattgattttatttatttatttttgaaaactacaacaaacgatagaagagttgaggaaatctctttgtaatcataattatgagaaaattaagatc

SEQ ID NO: 111 - DNA, 1109 bp, arabidopsis thaliana
  sequence of STAR A27
gatcggaatcattttgggagtttgaaggaactaaacataatatgcatgtcgaagtcaacttattgcaaataattttgaaatgattctgaattggaaattcatgaagcttaattattttatctaaataagtttaatataggtttgagtgagatatcgagattaaatgataagagtctttcttcgaggagacattagaattctacacaaaaatcgaaattaatctagtccttgacaatcagttttcaattaatcaaaaacctataaaattcaactcaaaaccaatcgtatgaaacttcattataccatataatctggttacttagcttaaatctctacccggcgatgtttcatgcttgagagactaggtacataggacactaggagtactgcatatatggttacctcatgagttctcatcgtaaaatcatccaataaaaaatggtttcctgcttaggtatacggtataccatcttgtatcgttaaaatttatagctcagttcgttgctaacagtcaaatacgtctttccagggtaaaaaatgtggaaatttgttccactgtaaaaacctaataatttttgacattaataattaaaagggattataatgtaatatatacaaagataggggagacagagacgaaggcccacacatctttaacaaaagaacaacaagcccgtgaccccaaaataaaactagctttcagatttattatttttcatctgacataattgcaaccgttagatttcatttctcaggtcccattctgactcagatccaaccgtccatattcctctagtgtcttcaatagttgggccccttttctttttcctctcgccgtacactctccttccagcgccaacgccaccgcccgagccacttcttccgccggcgccaccgcgatttcctcgccggaatcccctccttcgccgcctttcccgtagaccacggaaaggatgcttatggcgtattctctccctctaccagccaatctcgccatcaccgctaccatcgccggcaccgtcatcgcgtgagcgcgaacctccgccgctccttctgccgttgtacacattagctcaagagcagctaaggctcgctccaccgctgagatc

SEQ ID NO: 112 - DNA, 1659 bp, arabidopsis thaliana
  sequence of STAR A28
gatcgaactttggtaacatgcttgcttactgctttctattgtctgcaaaacctctgttctgggtgaccttctggcccctctctctcgaagcttcagaactatggaggagagattggataaaggagacaaaaggtgtggtgtggcgaaatgttagggtaccggcaattgtgtatgtatgagttgattttgttcttttctcataaagaggatttaacaaaggatgagaaaacaaatccaacttgagtactacgaggagataaaagcttttattgggtattgagtattgacacgttgttgaaagtctgatacattttagacttttactgcatatgtccaaatatttagatttttttttcgtttctcaaaaaagtaacttgtttaacaaaaaaaaatcgttattgggcttttcgtttcttttatattgggccttgagcctttttagcttttgtatttttagtccttttcgggtttatttatttattaataagataccaaaaacataacaaaaatgtagttttgtatttttaacctagtcttttaaatatttaaacttaattagaaaaattctatttaaaatattataaaaaaaacatgattttgtgattttcccatattttgtgtaactatttttgacaagcttttgaaacaacaaagacaaaatccatgtgataaggtcggtcaaaaatcttgcgtagtagaggagttaaagatttttggatggttacaatggtatactcttatttgatatcccatcaatggtatatagctttgaatggtaggacaagtgagagtaaaattttctcatcattgctaagttttattttaggttctacattgtttcacccttcttaagtatcctactctcaactagaaaaaaaaattgtgagggcggttttatcggctggaatgcagctcatgtagctcccacgacggagttttctggctaagaaactcggacacaacgttggcctccaatatcttcaaggcttcttcattcgtcaccgacctcggtgtcttatactgactcacagaagagcctctagacagaaagaagttcatgagcttgtcgaaagcgccaggcttaacaaccttaatctcaagtggtccaatgttcttatcattctttcgtccttttctgtaaaccgcgtccagagactcctcaatggtgaagcagcattcctccaaaacattctggtcaagctcaagcttggcgtccttgacttttctcccgagttcccagtagagcacgtagtgacctggatacgaggaggaatccacacggctagtgaaatccatgagcattaggtcatgtggctcaagcaggagactcgcgttagtcactgccttgaggaggtcttcgtcgtaggtcttgtccatgtcgatgctcagaacaactttctgtcttcccacgaaatgaaactgtggcgcattgttgtagaaaccagtcactcttaaaacgtcccctaaacggtacctatacaaacctgtataaagaattttgatacacattaagaaaattattaacatgtcatttagttttgaaattgagagagtaaacaagaaaaaacacttaccagcaaacgttgtgacaacaggttcataatcatgaccgattttaacatcgacaagatcgactacaacaggattctctgcgggatc

SEQ ID NO: 113 - DNA, 874 bp, arabidopsis thaliana
  sequence of STAR A29
gatcagagtcacaaccataggagtcggagacggccatgcatgtgtcttgatagaagaattaaccggttctaaatctgaaaacgaatccggtcgtctcgaaccgaaatcaataaccggtccggtcaaagaaacggttgcacgagtgaaggaaacggttacgaaaacggagccgttaatatgcgatgacggagtgacaaaggggaagctgacgatgtgctacgaggtagacgttgacgttgacggtgggaggtgtgttaacggagatttaacggcagttagctacggaggaggtttgggtaattgtggcggggattggtgggagaaatgggatggagtggtgaggatgagaaatggtgatgacagttggtaccgttacgtggatttaacggtgattaatggaaatgtggtaaggttatgggatgacaacaaaacactagtaacggcggcatgtgtctaaattagagaagtttcatatttcggaaagtttttaaatcttgagaagctttcttggtttgaagtgttttttttttgttggttgattaagttgtaatttgtaaataattttcacacaagagaccaagaaggaacgcttaaatcaatatcaattggtgttgattcccagctttttctagtcgaacttaggtaacacgtccattgcgatgatgaattcgtgacaaggggtcaactatttgaacacaacaaacaagtgcgttttcttgttaaggcccatctaaaattgactacacacatttacttttaggcccattttaaacttgactgtagcctgtaggcatgtatttgttcgtgttactcccagcctcaaacccgcaaaatccacgaattcttcttacttagtctagactctggtctgatc

SEQ ID NO: 114 - DNA, 2138 bp, arabidopsis thaliana
  sequence of STAR A30
gatctggctaatccgtttagcacacaaccagatgtaacattggttgcaaagattattgaagagtctcgatctaatgtaacacacctctgcgcattcaggagtgcttacgtcaacacattccgggaacgaaaaactgttagcgtatgtgtattttaaagtattaccatatttctttatatcttctagcacctcctcacaaatgtcacgtgcgtcctccgattccaaagcataatggttgcttccgaagagccgaaggtagacaccacccatgtgagcattaccagcacatatgtaaagaattgcgcatgcaagggttgcagcggcgttccttggggcgattcgctctaagtgtaggatagctccctggatgtcagactcatgtgtaacgagacgcagtccttcatggtaaatagccgtggggttaccagcttgtaagcaccgtttgaagaagggtctatagcgaccttcggagttgatgtcatttggatcgtggcctgccgcgtagaagtcatcgggatcgtcgcacatgctgaaaatgtttgcatttttgaggacatccggacagtagacaatgtctcttccacgaggaccggatttcaacataggtccgaggtaccaccaacatttgtcagccattttcttggctatcttcgcaagcaaatcgtcaggaatatttgggtttgtcatatttaggagtaaggtgtttcgagaaaatgaaatttgaacacttaaataagcatcattgaagatatggttgggtaagttatggttgtatttattgcaaaggtattaagtgatgatgtgtattcatattgtcaaatcaaagtaatagtattccatatataatttgttatcgttgttatgagcaacctctttttattaacagcttaaaactagacgtgtacgttttactgacggtcttagtgtacgtccacatttacatttctacatttactcaacaaacagtgtacgttgtagtgtatgttttagtgaacgtccacatttacatttctacatttgcccaacaaacagtgtacgttgtagtgtacgtccacatttacatttctacatttgcccaacaaacagtgtacgttgtagtgtacgtttaagtgtacgtccacatttacatttctacatttgcccaacaaacagtgtacgttgtagtgtacgttttagtgtacgtccatatttacatttctacatttactcaacagacagtgtacgctgtagtgtactattagtgtacgtccattcataaatatcaccatttatgagacaaaccaaagacctcatacgtttgcatgtgttattttttagtgtacgttagagttgatatctcatgctagtgaacgtccatatctagttttccgagacaaagaaaaaacctctaagtattatttggtagatgcacgtgtacggagttgtggacgcttagattttaatatccaaatttacatttactgcagtgtctaaatatcatatgtgaatttggctgaaaaatattcaacttgagaaacataacacaccttgcaaatttcttaagcaataatataatttcaacataaacataaacaacatagtagaaggcttatcataatttgaaacatgacatagcggataacataaacaaacatataaagtagaatggaataactatagcatttgactaacacgcctggcacacgaccagaggtaacagcggttgcaaacgttttggaaagctcctgataccatgtaacaatataaggcgcaaggaggcatactaattccatggctggtaggataagagaacgtaggaccatatgtattgctgtatggagggtcaaacttctttatttcctcgatgaactcatcacccaaaactcgagtggcaaccgagtccaatggataatggttgcgggtgaagagctgtagaaacaagccgcccatataatcatacccagcacatatgaatacaatggcgcatgcaagtgttgcatttgctcgtactggagcatgacgctgtaagagcctgatggctccattgatgtttcgttcatgcgttagaacacgaataccttcgtaatacacggccgtgggattattagctgcaaaacaccttaagaaaaatgttcgatgtcggccttcatcagcggatc

SEQ ID NO: 115 - DNA, 2092 bp, arabidopsis thaliana
  sequence of STAR A31
gatcaaaagaatcgtacttgaaatatttagtggaacgcatatgtcagagttacagatatggtttaactctttttatctcctttttttaatggtgtttctctttttatctcctataatcttttgggaattttttattattaaatattaattaaaaagataaattcttagagaaaatcccaactgacttgttaactagtgagacatatcttatttattctctgcttatctaaaaagaaaatgaaaaagaaaaaaaaagtatatattagaagattaatataagtttagggggaaaatgattattattactatttataaaattagtatatttcaaaattgtacaattaattactaagccttaaaataaaaatgtaaaagaagattatcatcaagaatagtataccatctttgtttcaaaagaaaagtttactaaaagaaaaaacttttgtttaatttctactaaagctgaaaggaaaatgattgtcaatttgttattattattatttatatgatagatttcttaagaaacgtatagagttagttacaaattctaaattaaaaattgtatgataagattatcttaagaaagttatacaatatattcctaattctaaaagaaaatggttatttttttggaatagatatacacaacaaaacaaatttagtataagaagatatgttagattaactaaataaacatctcaggcatgaaactggattaggttaaccagaggtccagagacctatatatctctaggcattagggtttaactacggagcaaagcctcataatcaagtttatatcttgcgcatctttagcaaccaatcaattatctaagaagccatgactaatactaatgttgctgctacaaagcctctttctactatggtcgatgaatctcctagccttctccgtgattggtggtgagactctagatcaatgatttttcttacttttttcccattactatgttatgttacgtaacataagatggattaaactgaatctgatcctcttaaattatattggttgcagtatgaacaagaacctacaatacaactttgcgatgaacttcgtcatgataatcatcaacattgaagcaatcttgtctatcagaaaccacgaaaatcacgtaaggaaagattattcaacgattttgataatttccggtatgttcttgcctttcgcctattaagttgcgtttgttgggttggcgcaatcagggatgtgacattatgtgaactcgcctacatcttcggacgcatcagtcacaacataggctttattttcttcctagaactcctctattgtatttctccctacttggctctactcgttggtctacatgtaggccaatggtatctaacttccatgattggactgtctctatgggaaggaatgcaagcattacgaactgatatttaacctcgtttaatagtaaaatctaaacttatttagctgcatattttggtttaaggcaatcgagaatgtcttagcatctaaagcttacttcgtgggacgcatctgtcacacgttcggcttttgtattttcgtccacctcctctattcggtttctcctcacttggctctatacttcggtctcccttgtttgctaggtttcgtagccgtcatgattgcaccaagttgtccgtatcaatggaaaggcctatgcaacaaagtgcaagagttacgagactggtggaagcatgtgaatcgaccacaatcctcggttgttattgttcaaggatctccatttctaagatgtgaattttaggactcttttatcccttttgccttttaaattggaataccaacgtttattatgtgggttagttatgtgtgtatatgatatacaaatcaaacaacatatataaggagaagagatattgaatgttgattcttaatttacaggaacatgaagctcgggtctttccggcaatgccatcaatatccgaggcggtgcagtttcttcgtcagacgagaaaccagagagtctagtatcctaattttgaacaaatagagcataaaggaacaagttatatagcttcacataacccgaaacatgttttaagtttcaatatcaaagacaagatc

SEQ ID NO: 116 - DNA, 1290 bp, arabidopsis thaliana
  sequence of STAR A32
gatctagacatatgtgtgagacgtttcattgtaggtatctgaatgtaaagctcaaagctttaacctttgaaccgataaacctctaaagctctctcttttccttggatgagtctcacaagttaagaacttcagtgaaataatctgactttattgaacccaaacttgggtatcactgtttatcttagcattacagagttttgtttttgttatgtacattggatttgaagtctacaatgtttttccaggtttataaaccggaagaatatagccgggttctagctatctgtggtcctgggaacaatggtggtgatggtttggtggcggcgaggcatttgcaccactttggatataaaccgtttatttgttatcccaaacgtacagccaagccactttatactggactggtcactcaggtttgtgtaaccagtgcttaatttatgggggatctttgttagctttctccgtttctttactgcctgctgaatttgcctgtttttgtagttggattcactctcagtcccttttgtttccgttgaggatctgccggatgacttgtcaaaggactttgatgttattgtagatgcaatgtttgggttttcattccatggtaactatttttgtgcatgaatcgttagaattcttcaaagcatgaaacaattataagaagtaaattcatcaaacttttgaacagcaagttttggaatcaaagtctcagagatgcaccttattcatttgcatcatgtttcagttggcctttgaaaatccattttttgcacatgtaggagctcccaggcctccttttgatgacctcatccggcgattagtatcgttacagaactatgagcagactcttcaaaaacacccagtcattgtctctgtggatattccctctggttggcacgttgaagaaggagaccatgaagatggaggaattaagcctgatatgttggtaagtcttagccgaaatgcttgtgtttctctttttctcttgtactcatttgttactatctgatataatgaaaactactttataaattgaacatatttactctttttaggtatctttgactgccccaaaattatgtgcaaagagattccgtggccctcatcactttttaggtgggagatttgtaccaccttctgttgcagaaaagtataagctggagctccctagttacccagggacatctatgtgtgttagaattggtaaacctcccaaagttgacatatctgctatgagagtgaactatgtctctccagaattgcttgaggagcaggttgaaactgatc

SEQ ID NO: 117 - DNA, 869 bp, arabidopsis thaliana
  sequence of STAR A33
gatcccgttcatgtatttttgccagttcgagttggggttggttctgtttactttttctagtccatgtattttgcagacctattaaaaccattctgttttttttttggaccaacaaaacccatccgtttttagatacgaaaataaaattttattaaaaccattatttttcttggaccatcaaaacccatccgtttaaagatacgaaatgaaattcgattgataaatacaaaataaagttcaccaaacttaaataaaaaggcatagatgggaccaatgagaaagaaatttcttttctcctcaatttccccaaaaatatataaaccttaagtttacttttttgttgcaaggaaaaacattaatctttttcaactttctaaaaacaatcatttcaaacgttaaaggaacctcctcctttctttacgcgtttgcaatataacccaagaagaccgcttgtttgtacaactttccaaaaaccaaacagtagtgtaataaacctctgacttcttttttcttctctatttttgtgggtgataatcaattcactcggtttgaaatttcgtccacttttcaaagatgagtgaatgaaaaagccacgaaactttccatttcttcctctgtgtataactctcactgagtacgacttgccattttctcatccaaaaaaaatgtttatccaaatacatatttgtgaactttgcttttaaaccactcaagattcttccccatggcttcttcgtcttcttcttctcggtctcgcacctggagataccgcgtcttcacgaacttccatggacctgacgtccgtaaaacattcctcagccatttacgtaaacagtttagctacaacgggatttcgatgtttaatgatc

SEQ ID NO: 118 - DNA, 921 bp, arabidopsis thaliana
  sequence of STAR A34
gatccatgcttttgagtttaagtgatttatttaagatcctctaaacttttttttcttcacttagtggtggttccagtcaatttagcaagtaagatgttgtatgtgtcaatgctataactgtgaattttcagctattgtagtttgatttttgtctttgttagcttcaggtgtcttgaatctgaatctgtggctatatttggtgctcggtggtgagcaggaagggagggggatattgtcagggttttaatgtacgtcagatgaatagagcaactaatgttactggcagtagaaggagggggtttattctcagcgtccgcgtctgggtatagtaagggattgacccttcttttctctggtgataaagacgtagataggcccatgagagttgtcccgtggaatcactaccaggtggttgaccaagagcctgaggctgaccctgttcttcagctggattctattaagaaccgagtttcccgcggttgcgctgcttccttcagttgttttggtggcgcttccgcgggacttgagaccccttctcctcttaaagttgaacctgtgcagcagcagcatcgtgaaatatcatcaccagagtctgttgttgttgtttctgaaaagggtaaagaccaaataagtgaagctgataatggcagcagcaaagaagctttcaaactctcgttgaggagtagcttgaagaggccctctgttgcggaatcacgctctctagaagatataaaagaatacgagacgttgagtgtggatggtagcgatctcactggtgacatggcaaggcggaaagttcagtggcctgatgcttgtggtagtgaactcactcaagttagagaatttgagccgaggtacgtgtgatatgttttcctcttattgagttgcttaaatcccaatacgagttaatttaagtagatc

SEQ ID NO: 119 - DNA, 1140 bp, arabidopsis thaliana; identical to SEQ ID NO: 97
  sequence of STAR A35

SEQ ID NO: 120 - DNA, 6 bp, Artificial Sequence
  palindromic DNA sequence
  misc_feature (3)..(4): "N" stands for any nucleotide
canntg

SEQ ID NO: 121 - DNA, 6 bp, Artificial Sequence
  oligonucleotide
aaaaaa

SEQ ID NO: 122 - DNA, 6 bp, Artificial Sequence
  oligonucleotide
tttttt

SEQ ID NO: 123 - DNA, 6 bp, Artificial Sequence
  hexamer
acgtga

SEQ ID NO: 124 - DNA, 26 bp, Artificial Sequence
  oligonucleotide
gtacggatatcagatctttaattaag

SEQ ID NO: 125 - DNA, 26 bp, Artificial Sequence
  oligonucleotide
gtaccttaattaaagatctgatatcc

SEQ ID NO: 126 - DNA, 52 bp, Artificial Sequence
  primer
gatcagatctggcgcgccatttaaatcgtctcgcgcgtttcggtgatgacgg

SEQ ID NO: 127 - DNA, 41 bp, Artificial Sequence
  primer
aggcggatccgaatgtatttagaaaaataaacaaatagggg

SEQ ID NO: 128 - DNA, 36 bp, Artificial Sequence
  primer
gatcggatccttcgaaatggccaagttgaccagtgc

SEQ ID NO: 129 - DNA, 32 bp, Artificial Sequence
  primer
aggcgcggccgcaattctcagtcctgctcctc

SEQ ID NO: 130 - DNA, 31 bp, Artificial Sequence
  primer
gatcgaattctcgcgacttcgcccaccatgc

SEQ ID NO: 131 - DNA, 52 bp, Artificial Sequence
  primer
aggcgaattcaccggtgtttaaacttacacccactcgtgcaggctgcccagg

SEQ ID NO: 132 - DNA, 37 bp, Artificial Sequence
  primer
gatcggatccttcgaaatgaccgagtacaagcccacg

SEQ ID NO: 133 - DNA, 34 bp, Artificial Sequence
  primer
aggcgcggccgctcaggcaccgggcttgcgggtc

SEQ ID NO: 134 - DNA, 40 bp, Artificial Sequence
  primer
gatctctagatcgcgaatggcctcctccgagaacgtcatc

SEQ ID NO: 135 - DNA, 37 bp, Artificial Sequence
  primer
aggcacgcgttcgcgactacaggaacaggtggtggcg

SEQ ID NO: 136 - DNA, 28 bp, Artificial Sequence
  primer
caagaattcaatggattttcaagtgcag

SEQ ID NO: 137 - DNA, 32 bp, Artificial Sequence
  primer
caagcggccgctttgtctctaacactcattcc

SEQ ID NO: 138 - DNA, 29 bp, Artificial Sequence
  primer
acagaattcttaccatggattttgggctg

SEQ ID NO: 139 - DNA, 31 bp, Artificial Sequence
  primer
acagcggccgctcatttaccaggagagtggg

SEQ ID NO: 140 - DNA, 48 bp, Artificial Sequence
  oligonucleotide C65
aacaagcttgatatcagatctgctagcttggtcgagctgatacttccc

SEQ ID NO: 141 - DNA, 54 bp, Artificial Sequence
  oligonucleotide C66
aaactcgagcggccgcgaattcgtcgactttaccactccctatcagtgatagag

SEQ ID NO: 142 - DNA, 39 bp, Artificial Sequence
  oligonucleotide C67
aaaccgcggcatggaagacgccaaaaacataaagaaagg

SEQ ID NO: 143 - DNA, 32 bp, Artificial Sequence
  oligonucleotide C68
tatggatcctagaattacacggcgatctttcc

SEQ ID NO: 144 - DNA, 33 bp, Artificial Sequence
  oligonucleotide C81
aaaccatggccgagtacaagcccacggtgcgcc

SEQ ID NO: 145 - DNA, 35 bp, Artificial Sequence
  oligonucleotide C82
aaatctagatcaggcaccgggcttgcgggtcatgc

SEQ ID NO: 146 - DNA, 22 bp, Artificial Sequence
  oligonucleotide C85
catttccccgaaaagtgccacc

SEQ ID NO: 147 - DNA, 24 bp, Artificial Sequence
  oligonucleotide D30
tcactgctagcgagtggtaaactc

SEQ ID NO: 148 - DNA, 28 bp, Artificial Sequence
  oligonucleotide D41
gaagtcgacgaggcaggcagaagtatgc

SEQ ID NO: 149 - DNA, 29 bp, Artificial Sequence
  oligonucleotide D42
gagccgcggtttagttcctcaccttgtcg

SEQ ID NO: 150 - DNA, 23 bp, Artificial Sequence
  oligonucleotide D51
tctggaagctttgctgaagaaac

SEQ ID NO: 151 - DNA, 17 bp, Artificial Sequence
  oligonucleotide D58
ccaagttgaccagtgcc

SEQ ID NO: 152 - DNA, 19 bp, Artificial Sequence
  oligonucleotide D70
tacaagccaaccacggcct

SEQ ID NO: 153 - DNA, 20 bp, Artificial Sequence
  oligonucleotide D71
cggaagtgcttgacattggg

SEQ ID NO: 154 - DNA, 20 bp, Artificial Sequence
  oligonucleotide D80
gttcgtggacacgacctccg

SEQ ID NO: 155 - DNA, 21 bp, Artificial Sequence
  oligonucleotide D89
gggcaagatgtcgtagtcagg

SEQ ID NO: 156 - DNA, 30 bp, Artificial Sequence
  oligonucleotide D90
aggcccatggtcacctccatcgctactgtg

SEQ ID NO: 157 - DNA, 20 bp, Artificial Sequence
  oligonucleotide D91
ctaatcactcactgtgtaat

SEQ ID NO: 158 - DNA, 15 bp, Artificial Sequence
  oligonucleotide D93
aattacaggcgcgcc

SEQ ID NO: 159 - DNA, 15 bp, Artificial Sequence
  oligonucleotide D94
aattggcgcgcctgt

SEQ ID NO: 160 - DNA, 25 bp, Artificial Sequence
  oligonucleotide D95
tgctttgcatacttctgcctgcctc

SEQ ID NO: 161 - DNA, 20 bp, Artificial Sequence
  oligonucleotide E12
taggggggatccaaatgttc

SEQ ID NO: 162 - DNA, 20 bp, Artificial Sequence
  oligonucleotide E13
cctaaaagaagatctttagc

SEQ ID NO: 163 - DNA, 20 bp, Artificial Sequence
  oligonucleotide E14
aagtgttggatccactttgg

SEQ ID NO: 164 - DNA, 20 bp, Artificial Sequence
  oligonucleotide E15
tttgaagatctaccaaatgg

SEQ ID NO: 165 - DNA, 20 bp, Artificial Sequence
  oligonucleotide E16
gttcgggatccacctggccg

SEQ ID NO: 166 - DNA, 20 bp, Artificial Sequence
  oligonucleotide E17
taggcaagatcttggccctc

SEQ ID NO: 167 - DNA, 20 bp, Artificial Sequence
  oligonucleotide E18
cctctctagggatccgaccc

SEQ ID NO: 168 - DNA, 20 bp, Artificial Sequence
  oligonucleotide E19
ctagagagatcttccagtat

SEQ ID NO: 169 - DNA, 20 bp, Artificial Sequence
  oligonucleotide E20
agagttccggatccgcctgg

SEQ ID NO: 170 - DNA, 20 bp, Artificial Sequence
  oligonucleotide E21
ccaggcagactcggaactct

SEQ ID NO: 171 - DNA, 20 bp, Artificial Sequence
  oligonucleotide E22
tggtgaaaccggatccctac

SEQ ID NO: 172 - DNA, 20 bp, Artificial Sequence
  oligonucleotide E23
aggtcaggagatctagacca

SEQ ID NO: 173 - DNA, 22 bp, Artificial Sequence
  oligonucleotide E25
ccattttcgcttccttagctcc

SEQ ID NO: 174 - DNA, 22 bp, Artificial Sequence
  oligonucleotide E42
cgatgtaacccactcgtgcacc

SEQ ID NO: 175 - DNA, 20 bp, Artificial Sequence
  oligonucleotide E57
agagatctaggataatttcg

SEQ ID NO: 176 - DNA, 32 bp, Artificial Sequence
  oligonucleotide E84
gatctctagaatggccaagcctttgtctcaag

SEQ ID NO: 177 - DNA, 37 bp, Artificial Sequence
  oligonucleotide E85
aggcgcggccgcttagccctcccacacataaccagag

SEQ ID NO: 178 - DNA, 31 bp, Artificial Sequence
  oligonucleotide E87
aggcacgcgttcatgtctgctcgaagcggcc

SEQ ID NO: 179 - DNA, 36 bp, Artificial Sequence
  oligonucleotide E92
aggcgctagcacgcgttctactcttttcctactctg

SEQ ID NO: 180 - DNA, 35 bp, Artificial Sequence
  oligonucleotide E93
gatcaagcttacgcgtctaaaggcattttatatag

SEQ ID NO: 181 - DNA, 35 bp, Artificial Sequence
  oligonucleotide E94
aggcgctagcacgcgttcagagttagtgatccagg

SEQ ID NO: 182 - DNA, 35 bp, Artificial Sequence
  oligonucleotide E95
gatcaagcttacgcgtcagtaaaggtttcgtatgg

SEQ ID NO: 183 - DNA, 36 bp, Artificial Sequence
  oligonucleotide E96
aggcgctagcacgcgttctactctttcattactctg

SEQ ID NO: 184 - DNA, 26 bp, Artificial Sequence
  oligonucleotide E97
cgaggaagctggagaaggagaagctg

SEQ ID NO: 185 - DNA, 25 bp, Artificial Sequence
  oligonucleotide E98
caagggccgcagcttacacatgttc

SEQ ID NO: 186 - DNA, 30 bp, Artificial Sequence
  oligonucleotide E99
gatcactagtatggccaagttgaccagtgc

SEQ ID NO: 187 - DNA, 32 bp, Artificial Sequence; identical to SEQ ID NO: 129
  oligonucleotide E100

SEQ ID NO: 188 - DNA, 33 bp, Artificial Sequence
  oligonucleotide F11
gatcgctagcaatcgcgacttcgcccaccatgc

SEQ ID NO: 189 - DNA, 31 bp, Artificial Sequence; identical to SEQ ID NO: 130
  oligonucleotide F14

SEQ ID NO: 190 - DNA, 47 bp, Artificial Sequence
  oligonucleotide F15
aggcgaattcaccggtgtttaaactcatgtctgctcgaagcggccgg

SEQ ID NO: 191 - DNA, 40 bp, Artificial Sequence
  oligonucleotide F16
gatcgaattctcgcgaatggtgagcaagcagatcctgaag

SEQ ID NO: 192 - DNA, 52 bp, Artificial Sequence; identical to SEQ ID NO: 131
  oligonucleotide F17

SEQ ID NO: 193 - DNA, 36 bp, Artificial Sequence; identical to SEQ ID NO: 128
  oligonucleotide F18

SEQ ID NO: 194 - DNA, 38 bp, Artificial Sequence
  oligonucleotide F19
gatcggatccttcgaaatgattgaacaagatggattgc

SEQ ID NO: 195 - DNA, 36 bp, Artificial Sequence
  oligonucleotide F20
aggcgcggccgctcagaagaactcgtcaagaaggcg

SEQ ID NO: 196 - DNA, 37 bp, Artificial Sequence; identical to SEQ ID NO: 132
  oligonucleotide F21

SEQ ID NO: 197 - DNA, 34 bp, Artificial Sequence; identical to SEQ ID NO: 133
  oligonucleotide F22

SEQ ID NO: 198 - DNA, 52 bp, Artificial Sequence; identical to SEQ ID NO: 126
  oligonucleotide F23

SEQ ID NO: 199 - DNA, 41 bp, Artificial Sequence; identical to SEQ ID NO: 127
  oligonucleotide F24

SEQ ID NO: 200 - DNA, 26 bp, Artificial Sequence
  oligonucleotide F25
gtacggatatcagatctttaattaag

SEQ ID NO: 201 - DNA, 26 bp, Artificial Sequence
  oligonucleotide F26
gtaccttaattaaagatctgatatcc

SEQ ID NO: 202 - DNA, 19 bp, Artificial Sequence
  oligonucleotide F32
gatcgaggtaccggtgtgt

SEQ ID NO: 203 - DNA, 19 bp, Artificial Sequence
  oligonucleotide F33
gatcacacaccggtacctc

SEQ ID NO: 204 - DNA, 17 bp, Artificial Sequence
  oligonucleotide F34
cggaggtaccggtgtgt

SEQ ID NO: 205 - DNA, 17 bp, Artificial Sequence
  oligonucleotide F35
cgacacaccggtacctc

SEQ ID NO: 206 - DNA, 18 bp, Artificial Sequence
  oligonucleotide F44
tgagaggtaccggtgtgt

SEQ ID NO: 207 - DNA, 18 bp, Artificial Sequence
  oligonucleotide F45
tcaacacaccggtacctc

SEQ ID NO: 208 - DNA, 631 bp, homo sapiens
  STAR elements in STAR3 forward
  misc_feature (5)..(630): "N" stands for any nucleotide on various positions
acgtnctaagnaaaccattattatcatgacattaacctataaaaataggcgtatcacgaggccctttcgtcttcactcgagcggccagcttggatctcgagtactgaaataggagtaaatctgaagagcaaataagatgagccagaaaaccatgaaaagaacagggactaccagttgattccacaaggacattcccaaggtgagaaggccatatacctccactacctgaaccaattctctgtatgcagatttagcaaggttataaggtagcaaaagattagacccaagaaaatagagaacttccaatccagtaaaaatcatagcaaatttattgatgataacaattgtctccaaaggaaccaggcagagtcgtgctagcagaggaagcacgtgagctgaaaacagccaaatctgctttgttttcatgacacaggagcataaagtacacaccaccaactgacctattaaggctgtggtaaaccgattcatagagagaggttctaaatacattggtccctcataggcaaaccgcagttcactccgaacgtagtccctggaaatttgatgtccagnatagaaaagcanagcagncnnnnnntatanatnnngntganccanatgntnnctgnnc

SEQ ID NO: 209 - DNA, 774 bp, homo sapiens
  STAR elements in STAR3 reverse
  misc_feature (637)..(762): "N" stands for any nucleotide on various positions
gagctagcggcgcgccaagcttggatcccgccccgccccctccgccctcgagccccgccccttgccctagaggccctgccgaggggcggggcctgtccctcctcccctttcccccgccccctaccgtcacgctcaggggcagcctgaccccgagcggccccgcggtgaccctcgcgcagaggcctgtgggaggggcgtcgcaagcccctgaatccccccccgtctgttcccccctcccgcccagtctcctccccctgggaacgcgcggggtgggtgacagacctggctgcgcgccaccgccaccgcgcctgccgggggcgctgccgctgcctgagaaactgcggctgccgcctggaggaggtgccgtcgcctccgccaccgctgccgccgccgccaggggtaggagctaagccgccgccattttgtgtccccctgttgttgtcgttgacatgaatccgacatgacactgattacagcccaatggagtctcattaaacccgagtcgcggtcccgccccgccgctgctccattggaggagaccaaagacacttaaggccacccgttggcctacgggtctgtctgtcacccactcactaaccactctgcagcccattggggcaggttcctgccggtcatntcgcttccaataaacacaccccttcgaccccatnattcccccccttcgggaaccacccccgggggaggggtccactggncaataccaattnaanagaaccgctngggtccgcctntttncgggcnccctattgggtt

SEQ ID NO: 210 - DNA, 717 bp, homo sapiens
  STAR elements in STAR4 forward
  misc_feature (444)..(704): "N" stands for any nucleotide on various positions
ggggaggattcttttggctgctgagttgagattaggttgagggtagtgaaggtaaaggcagtgagaccacgtaggggtcattgcagtaatccaggctggagatgatggtggttcagttggaatagcagtgcatgtgctgtaacaacctcagctgggaagcagtatatgtggcgttatgacctcagctggaacagcaatgcatgtggtggtgtaatgaccccagctgggtagggtgcatgtgatggaacaacctcagctgggtagcagtgtacttgataaaatgttggcatactctacatttgttatgagggtagtgccattaaatttctccacaaattggttgtcacgtatgagtgaaaagaggaagtgatggaagacttcagtgcttttggcctgaataaatagaagacgtcattttcagtaatggagacagggaagactaangnagggtggattcagtagagcaggtgttcagttttgaatatgatgaactctgagagaggaaaaactttttctacctcttagtttttgngnctggacttaanattaaaggacatangacngagancagaccaaatntgcgangtttttatattttacttgcngagggaatttncaagaaaaagaagacccaananccattggtcaaaactatntgccttttaanaaaaaganaattacaatgganananaagtgttgnctnggcaaaaattggg

SEQ ID NO: 211 - DNA, 541 bp, homo sapiens
  STAR elements in STAR4 reverse
  misc_feature (6)..(533): "N" stands for any nucleotide on various positions
ggattngagctagcggcgcgccaagcttggatcttagaaggacagagtggggcatggaaatgcaccaccagggcagtgcagcttggtcactgccagctccnctcatgggcagagggctggcctcttgcagccgaccaggcactgagcgccatcccagggccctcgccagccctcagcagggccaggacacacaagcctttgacttcctcctgtcactgctgctgccattcctgttttgtggtcatcactccttccctgtcctcagactgcccagcactcaaggatgtcctgtggtggcatcagaccatatgcccctgaanaggagtgagttggtgttttttgccgcgcccanagagctgctgtcccctgaaagatgcaagtgggaatgatgatgntcaccatcntctgacaccaagccctttggatagaggccccaacagtgaggatggggctgcactgcattgccaaggcaactctgtnntgactgctacangacantcccaggacctgngaagnnctatanatntgatgcnaggcacct

SEQ ID NO: 212 - DNA, 794 bp, homo sapiens
  STAR elements in STAR6 forward
  misc_feature (374)..(792): "N" stands for any nucleotide on various positions
ccaccacagacatcccctctggcctcctgagtggtttcttcagcacagcttccagagccaaattaaacgttcactctatgtctatagacaaaaagggttttgactaaactctgtgttttagagagggagttaaatgctgttaactttttaggggtgggcgagaggaatgacaaataacaacttgtctgaatgttttacatttctccccactgcctcaagaaggttcacaacgaggtcatccatgataaggagtaagacctcccagccggactgtccctcggcccccagaggacactccacagagatatgctaactggacttggagactggctcacactccagagaaaagcatggagcacgagcgcacagagcangggccaaggtcccagggacngaatgtctaggagggagattggggtgagggtantctgatgcaattactgngcagctcaacattcaagggaggggaagaaagaaacngtccctgtaagtaagttgtncancagagatggtaagctccaaatttnaactttggctgctggaaagtttnngggccnananaanaaacanaaanatttgaggtttanacccactaacccntatnantanttattaatacccctaattanaccttggatanccttaaaatatcntntnaaacggaaccctcnttcccntttnnaaatnnnaaaggccattnngnncnagtaaaaatctnnnttaagnnntgggcccnaacaaacntnttccnagacacnttttttntccnggnatttntaatttatttctaancc

SEQ ID NO: 213 - DNA, 379 bp, homo sapiens
  STAR elements in STAR6 reverse
  misc_feature (287)..(379): "N" stands for any nucleotide on various positions
atcgtgtcctttccagggacatggatgaagctggaagccatcatcctcagcaaactaacacaggaacagaaaaccaaataccacatgttctcactcataagtgggagctgaacagtgagaacacatggacacagggaggggaacatcacacaccaaggcctgtctggtgtggggaggggagggagagcatcaggacaaatagctaatgcatgtggggcttaaacctagatgacgggttgataggtgcagcaatccactatggacacatatacctatgtaacaacccnaccttnttgacatgtatcccagaacttaaaggaaaataaaaattaaaaaaaattnccctggaataaaaaagagtgtggactttggtgagatn

SEQ ID NO: 214 - DNA, 398 bp, homo sapiens
  STAR elements in STAR8 forward
  misc_feature (98)..(395): "N" stands for any nucleotide on various positions
ggatcacctcgaagagagtctaacgtccgtaggaacgctctcgggttcacaaggattgaccgaaccccaggatacgtcgctctccatctgaggcttgntccaaatggccctccactattccaggcacgtgggtgtctcccctaactctccctgctctcctgagcccatgctgcctatcacccatcggtgcaggtcctttctgaanagctcgggtggattctctccatcccacttcctttcccaagaaagaagccaccgttccaagacacccaatgggacattcccnttccacctccttntcnaaagttngcccaggtgttcntaacaggttagggagagaancccccaggtttnagttncaaggcataggacgctggcttgaacacacacacacnctc

SEQ ID NO: 215 - DNA, 309 bp, homo sapiens
  STAR elements in STAR8 reverse
  misc_feature (72)..(72): "N" stands for any nucleotide
ggatcccgactctgcaccgcaaactctacggcgccctgcaggacggcggcctcctgccgcttggacgccagncaggagctccccggcagcagcagagcagaaagaaggatggccccgccccacttcgcctcccggcggtctccctcccgccggctcacggacatagatggctgcctagctccggaagcctagctcttgttccgggcatcctaaggaagacacggtttttcctcccggggcctcaccacatctgggactttgacgactcggacctctctccattgaatggttgcgcgttctctgggaaag

SEQ ID NO: 216 - DNA, 606 bp, homo sapiens
  STAR elements in STAR18 forward
  misc_feature (524)..(524): "N" stands for any nucleotide
tggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccgagctttggcttgcgcgtatttttccggtcgcggacatcccaccgcgcagagcctcgcctccccgctgncctcagctccgatgacttccccgcccccgccctgctcggtgacagacgttctactgcttccaatcggaggcacccttcgcgg

SEQ ID NO: 217 - DNA, 465 bp, homo sapiens
  STAR elements in STAR18 reverse
tggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccgagctttggc

SEQ ID NO: 218 - DNA, 6 bp, Artificial Sequence
  oligonucleotide patterns over-represented in STAR elements
ccccac

SEQ ID NO: 219 - DNA, 6 bp, Artificial Sequence
  oligonucleotide patterns over-represented in STAR elements
cagcgg

SEQ ID NO: 220 - DNA, 6 bp, Artificial Sequence
  oligonucleotide patterns over-represented in STAR elements
ggcccc

SEQ ID NO: 221 - DNA, 6 bp, Artificial Sequence
  oligonucleotide patterns over-represented in STAR elements
cagccc

SEQ ID NO: 222 - DNA, 6 bp, Artificial Sequence
  oligonucleotide patterns over-represented in STAR elements
gccccc

SEQ ID NO: 223 - DNA, 6 bp, Artificial Sequence
  oligonucleotide patterns over-represented in STAR elements
cggggc

SEQ ID NO: 224 - DNA, 6 bp, Artificial Sequence
  oligonucleotide patterns over-represented in STAR elements
ccccgc

SEQ ID NO: 225 - DNA, 6 bp, Artificial Sequence
  oligonucleotide patterns over-represented in STAR elements
cggcag

SEQ ID NO: 226 - DNA, 6 bp, Artificial Sequence
  oligonucleotide patterns over-represented in STAR elements
agcccc

SEQ ID NO: 227 - DNA, 6 bp, Artificial Sequence
  oligonucleotide patterns over-represented in STAR elements
ccaggg

SEQ ID NO: 228 - DNA, 6 bp, Artificial Sequence
  oligonucleotide patterns over-represented in STAR elements
ggaccc

SEQ ID NO: 229 - DNA, 6 bp, Artificial Sequence
  oligonucleotide patterns over-represented in STAR elements
gcggac

SEQ ID NO: 230 - DNA, 6 bp, Artificial Sequence
  oligonucleotide patterns over-represented in STAR elements
ccagcg

SEQ ID NO: 231 - DNA, 6 bp, Artificial Sequence
  oligonucleotide patterns over-represented in STAR elements
gcagcc

SEQ ID NO: 232 - DNA, 6 bp, Artificial Sequence
  oligonucleotide patterns over-represented in STAR elements
ccggca

SEQ ID NO: 233 - DNA, 6 bp, Artificial Sequence
  oligonucleotide patterns over-represented in STAR elements
agcggc

SEQ ID NO: 234 - DNA, 6 bp, Artificial Sequence
  oligonucleotide patterns over-represented in STAR elements
cagggg

SEQ ID NO: 235 - DNA, 6 bp, Artificial Sequence
  oligonucleotide patterns over-represented in STAR elements
ccgccc

SEQ ID NO: 236 - DNA, 6 bp, Artificial Sequence
  oligonucleotide patterns over-represented in STAR elements
cccccg

SEQ ID NO: 237 - DNA, 6 bp, Artificial Sequence
  oligonucleotide patterns over-represented in STAR elements
gccgcc

SEQ ID NO: 238 - DNA, 6 bp, Artificial Sequence
  oligonucleotide patterns over-represented in STAR elements
gccggc

SEQ ID NO: 239 - DNA, 6 bp, Artificial Sequence
  oligonucleotide patterns over-represented in STAR elements
cggacc

SEQ ID NO: 240 - DNA, 6 bp, Artificial Sequence
  oligonucleotide patterns over-represented in STAR elements
cgcccc

SEQ ID NO: 241 - DNA, 6 bp, Artificial Sequence
  oligonucleotide patterns over-represented in STAR elements
cgccag

SEQ ID NO: 242 - DNA, 6 bp, Artificial Sequence
  oligonucleotide patterns over-represented in STAR elements
cgcagc

SEQ ID NO: 243 - DNA, 6 bp, Artificial Sequence
  oligonucleotide patterns over-represented in STAR elements
cagccg

SEQ ID NO: 244 - DNA, 6 bp, Artificial Sequence
  oligonucleotide patterns over-represented in STAR elements
cccacg

SEQ ID NO: 245 - DNA, 6 bp, Artificial Sequence
  oligonucleotide patterns over-represented in STAR elements
gctgcc

SEQ ID NO: 246 - DNA, 6 bp, Artificial Sequence
  oligonucleotide patterns over-represented in STAR elements
ccctcc

SEQ ID NO: 247 - DNA, 6 bp, Artificial Sequence
  oligonucleotide patterns over-represented in STAR elements
ccctgc

SEQ ID NO: 248 - DNA, 6 bp, Artificial Sequence
  oligonucleotide patterns over-represented in STAR elements
cacccc

SEQ ID NO: 249 - DNA, 6 bp, Artificial Sequence
  oligonucleotide patterns over-represented in STAR elements
gcgcca

SEQ ID NO: 250 - DNA, 6 bp, Artificial Sequence
  oligonucleotide patterns over-represented in STAR elements
aggggc

SEQ ID NO: 251 - DNA, 6 bp, Artificial Sequence
  oligonucleotide patterns over-represented in STAR elements
gagggc

SEQ ID NO: 252 - DNA, 6 bp, Artificial Sequence
  oligonucleotide patterns over-represented in STAR elements
gcgaac

SEQ ID NO: 253 - DNA, 6 bp, Artificial Sequence
  oligonucleotide patterns over-represented in STAR elements
ccggcg

SEQ ID NO: 254 - DNA, 6 bp, Artificial Sequence
  oligonucleotide patterns over-represented in STAR elements
agccgg

SEQ ID NO: 255 - DNA, 6 bp, Artificial Sequence
  oligonucleotide patterns over-represented in STAR elements
ggagcc

SEQ ID NO: 256 - DNA, 6 bp, Artificial Sequence
  oligonucleotide patterns over-represented in STAR elements
ccccag

SEQ ID NO: 257 - DNA, 6 bp, Artificial Sequence
  oligonucleotide patterns over-represented in STAR elements
ccgctc

SEQ ID NO: 258 - DNA, 6 bp, Artificial Sequence
  oligonucleotide patterns over-represented in STAR elements
cccctc

SEQ ID NO: 259 - DNA, 6 bp, Artificial Sequence
  oligonucleotide patterns over-represented in STAR elements
caccgc

SEQ ID NO: 260 - DNA, 6 bp, Artificial Sequence
  oligonucleotide patterns over-represented in STAR elements
ctgccc

SEQ ID NO: 261 - DNA, 6 bp, Artificial Sequence
  oligonucleotide patterns over-represented in STAR elements
gggcca

SEQ ID NO: 262 - DNA, 6 bp, Artificial Sequence
  oligonucleotide patterns over-represented in STAR elements
cgctgc

SEQ ID NO: 263 - DNA, 6 bp, Artificial Sequence
  oligonucleotide patterns over-represented in STAR elements
cagcgc

SEQ ID NO: 264 - DNA, 6 bp, Artificial Sequence
  oligonucleotide patterns over-represented in STAR elements
cggccc

SEQ ID NO: 265 - DNA, 6 bp, Artificial Sequence
  oligonucleotide patterns over-represented in STAR elements
ccgccg

SEQ ID NO: 266 - DNA, 6 bp, Artificial Sequence
  oligonucleotide patterns over-represented in STAR elements
ccccgg

SEQ ID NO: 267 - DNA, 6 bp, Artificial Sequence
  oligonucleotide patterns over-represented in STAR elements
agccgc

SEQ ID NO: 268 - DNA, 6 bp, Artificial Sequence
  oligonucleotide patterns over-represented in STAR elements
gcaccc

SEQ ID NO: 269 - DNA, 6 bp, Artificial Sequence
  oligonucleotide patterns over-represented in STAR elements
aggacc

SEQ ID NO: 270 - DNA, 6 bp, Artificial Sequence
  oligonucleotide patterns over-represented in STAR elements
agggcg

SEQ ID NO: 271 - DNA, 6 bp, Artificial Sequence
  oligonucleotide patterns over-represented in STAR elements
cagggc

SEQ ID NO: 272 - DNA, 6 bp, Artificial Sequence
  oligonucleotide patterns over-represented in STAR elements
cccgcc

SEQ ID NO: 273 - DNA, 6 bp, Artificial Sequence
  oligonucleotide patterns over-represented in STAR elements
gccagc

SEQ ID NO: 274 - DNA, 6 bp, Artificial Sequence
  oligonucleotide patterns over-represented in STAR elements
agcgcc

SEQ ID NO: 275 - DNA, 6 bp, Artificial Sequence
  oligonucleotide patterns over-represented in STAR elements
aggccc

SEQ ID NO: 276 - DNA, 6 bp, Artificial Sequence
  oligonucleotide patterns over-represented in STAR elements
cccacc

SEQ ID NO: 277 - DNA, 6 bp, Artificial Sequence
  oligonucleotide patterns over-represented in STAR elements
cgctca

SEQ ID NO: 278 - DNA, 6 bp, Artificial Sequence
  oligonucleotide patterns over-represented in STAR elements
aacgcg

SEQ ID NO: 279 - DNA, 6 bp, Artificial Sequence
  oligonucleotide patterns over-represented in STAR elements
gcggca

SEQ ID NO: 280 - DNA, 6 bp, Artificial Sequence
  oligonucleotide patterns over-represented in STAR elements
aggtcc

SEQ ID NO: 281 - DNA, 6 bp, Artificial Sequence
  oligonucleotide patterns over-represented in STAR elements
ccgtca

SEQ ID NO: 282 - DNA, 6 bp, Artificial Sequence
  oligonucleotide patterns over-represented in STAR elements
cagagg

SEQ ID NO: 283 - DNA, 6 bp, Artificial Sequence
  oligonucleotide patterns over-represented in STAR elements
cccgag

SEQ ID NO: 284 - DNA, 6 bp, Artificial Sequence
  oligonucleotide patterns over-represented in STAR elements
ccgagg

SEQ ID NO: 285 - DNA, 6 bp, Artificial Sequence
  oligonucleotide patterns over-represented in STAR elements
cgcgga

SEQ ID NO: 286 - DNA, 6 bp, Artificial Sequence
  oligonucleotide patterns over-represented in STAR elements
ccaccc

SEQ ID NO: 287 - DNA, 6 bp, Artificial Sequence
  oligonucleotide patterns over-represented in STAR elements
cctcgc

SEQ ID NO: 288 - DNA, 6 bp, Artificial Sequence
  oligonucleotide patterns over-represented in STAR elements
caagcc

SEQ ID NO: 289 - DNA, 6 bp, Artificial Sequence
  oligonucleotide patterns over-represented in STAR elements
tccgca

SEQ ID NO: 290 - DNA, 6 bp, Artificial Sequence
  oligonucleotide patterns over-represented in STAR elements
cgccgc

SEQ ID NO: 291 - DNA, 6 bp, Artificial Sequence
  oligonucleotide patterns over-represented in STAR elements
gggaac

SEQ ID NO: 292 - DNA, 6 bp, Artificial Sequence
  oligonucleotide patterns over-represented in STAR elements
ccagag

SEQ ID NO: 293 - DNA, 6 bp, Artificial Sequence
  oligonucleotide patterns over-represented in STAR elements
cgttcc

SEQ ID NO: 294 - DNA, 6 bp, Artificial Sequence
  oligonucleotide patterns over-represented in STAR elements
cgagga

SEQ ID NO: 295 - DNA, 6 bp, Artificial Sequence
  oligonucleotide patterns over-represented in STAR elements
gggacc

SEQ ID NO: 296 - DNA, 6 bp, Artificial Sequence
  oligonucleotide patterns over-represented in STAR elements
ccgcga

SEQ ID NO: 297 - DNA, 6 bp, Artificial Sequence
  oligonucleotide patterns over-represented in STAR elements
cctgcg

SEQ ID NO: 298 - DNA, 6 bp, Artificial Sequence
  oligonucleotide patterns over-represented in STAR elements
ctgcgc

SEQ ID NO: 299 - DNA, 6 bp, Artificial Sequence
  oligonucleotide patterns over-represented in STAR elements
gacccc

SEQ ID NO: 300 - DNA, 6 bp, Artificial Sequence
  oligonucleotide patterns over-represented in STAR elements
gctcca

SEQ ID NO: 301 - DNA, 6 bp, Artificial Sequence
  oligonucleotide patterns over-represented in STAR elements
cgccac

SEQ ID NO: 302 - DNA, 6 bp, Artificial Sequence
  oligonucleotide patterns over-represented in STAR elements
gcggga

SEQ ID NO: 303 - DNA, 6 bp, Artificial Sequence
  oligonucleotide patterns over-represented in STAR elements
ctgcga

SEQ ID NO: 304 - DNA, 6 bp, Artificial Sequence
  oligonucleotide patterns over-represented in STAR elements
ctgctc

SEQ ID NO: 305 - DNA, 6 bp, Artificial Sequence
  oligonucleotide patterns over-represented in STAR elements
cagacg

SEQ ID NO: 306 - DNA, 6 bp, Artificial Sequence
  oligonucleotide patterns over-represented in STAR elements
cgagag

SEQ ID NO: 307 - DNA, 6 bp, Artificial Sequence
  oligonucleotide patterns over-represented in STAR elements
cggtgc

SEQ ID NO: 308 - DNA, 6 bp, Artificial Sequence
  oligonucleotide patterns over-represented in STAR elements
ctcccc

SEQ ID NO: 309 - DNA, 6 bp, Artificial Sequence
  oligonucleotide patterns over-represented in STAR elements
gcggcc

SEQ ID NO: 310 - DNA, 6 bp, Artificial Sequence
  oligonucleotide patterns over-represented in STAR elements
cggcgc

SEQ ID NO: 311 - DNA, 6 bp, Artificial Sequence
  oligonucleotide patterns over-represented in STAR elements
aagccc

SEQ ID NO: 312 - DNA, 6 bp, Artificial Sequence
  oligonucleotide patterns over-represented in STAR elements
ccgcag

SEQ ID NO: 313 - DNA, 6 bp, Artificial Sequence
  oligonucleotide patterns over-represented in STAR elements
gcccac

SEQ ID NO: 314 - DNA, 6 bp, Artificial Sequence
  oligonucleotide patterns over-represented in STAR elements
caccca

SEQ ID NO: 315 - DNA, 6 bp, Artificial Sequence
  oligonucleotide patterns over-represented in STAR elements
gcgccc

SEQ ID NO: 316 - DNA, 6 bp, Artificial Sequence
  oligonucleotide patterns over-represented in STAR elements
accggc

SEQ ID NO: 317 - DNA, 6 bp, Artificial Sequence
  oligonucleotide patterns over-represented in STAR elements
ctcgca

SEQ ID NO: 318 - DNA, 6 bp, Artificial Sequence
  oligonucleotide patterns over-represented in STAR elements
acgctc

SEQ ID NO: 319 - DNA, 6 bp, Artificial Sequence
  oligonucleotide patterns over-represented in STAR elements
ctggac

SEQ ID NO: 320 - DNA, 6 bp, Artificial Sequence
  oligonucleotide patterns over-represented in STAR elements
gcccca

SEQ ID NO: 321 - DNA, 6 bp, Artificial Sequence
  oligonucleotide patterns over-represented in STAR elements
accgtc

SEQ ID NO: 322 - DNA, 6 bp, Artificial Sequence
  oligonucleotide patterns over-represented in STAR elements
ccctcg

SEQ ID NO: 323 - DNA, 6 bp, Artificial Sequence
  oligonucleotide patterns over-represented in STAR elements
agcccg

SEQ ID NO: 324 - DNA, 6 bp, Artificial Sequence
  oligonucleotide patterns over-represented in STAR elements
acccga

SEQ ID NO: 325 - DNA, 6 bp, Artificial Sequence
  oligonucleotide patterns over-represented in STAR elements
agcagc

SEQ ID NO: 326 - DNA, 6 bp, Artificial Sequence
  oligonucleotide patterns over-represented in STAR elements
accgcg

SEQ ID NO: 327 - DNA, 6 bp, Artificial Sequence
  oligonucleotide patterns over-represented in STAR elements
cgaggc

SEQ ID NO: 328 - DNA, 6 bp, Artificial Sequence
  oligonucleotide patterns over-represented in STAR elements
agctgc

SEQ ID NO: 329 - DNA, 6 bp, Artificial Sequence
  oligonucleotide patterns over-represented in STAR elements
ggggac

SEQ ID NO: 330 - DNA, 6 bp, Artificial Sequence
  oligonucleotide patterns over-represented in STAR elements
ccgcaa

SEQ ID NO: 331 - DNA, 6 bp, Artificial Sequence
  oligonucleotide patterns over-represented in STAR elements
cgtcgc

SEQ ID NO: 332 - DNA, 6 bp, Artificial Sequence
  oligonucleotide patterns over-represented in STAR elements
cgtgac

SEQ ID NO: 333 - DNA, 6 bp, Artificial Sequence
  oligonucleotide patterns over-represented in STAR elements
cgccca

SEQ ID NO: 334 - DNA, 6 bp, Artificial Sequence
  oligonucleotide patterns over-represented in STAR elements
ctctgc

SEQ ID NO: 335 - DNA, 6 bp, Artificial Sequence
  oligonucleotide patterns over-represented in STAR elements
agcggg

SEQ ID NO: 336 - DNA, 6 bp, Artificial Sequence
  oligonucleotide patterns over-represented in STAR elements
accgct

SEQ ID NO: 337 - DNA, 6 bp, Artificial Sequence
  oligonucleotide patterns over-represented in STAR elements
cccagg

SEQ ID NO: 338 - DNA, 6 bp, Artificial Sequence
  oligonucleotide patterns over-represented in STAR elements
ccctca

SEQ ID NO: 339 - DNA, 6 bp, Artificial Sequence
  oligonucleotide patterns over-represented in STAR elements
ccccca

SEQ ID NO: 340 - DNA, 6 bp, Artificial Sequence
  oligonucleotide patterns over-represented in STAR elements
ggcgaa

SEQ ID NO: 341 - DNA, 6 bp, Artificial Sequence
  oligonucleotide patterns over-represented in STAR elements
cggctc

SEQ ID NO: 342 - DNA, 6 bp, Artificial Sequence
  oligonucleotide patterns over-represented in STAR elements
ctcgcc

SEQ ID NO: 343 - DNA, 6 bp, Artificial Sequence
  oligonucleotide patterns over-represented in STAR elements
cggaga

SEQ ID NO: 344 - DNA, 6 bp, Artificial Sequence
  oligonucleotide patterns over-represented in STAR elements
tcccca

SEQ ID NO: 345 - DNA, 6 bp, Artificial Sequence
  oligonucleotide patterns over-represented in STAR elements
gacacc

SEQ ID NO: 346 - DNA, 6 bp, Artificial Sequence
  oligonucleotide patterns over-represented in STAR elements
ctccga

SEQ ID NO: 347 - DNA, 6 bp, Artificial Sequence
  oligonucleotide patterns over-represented in STAR elements
ctcgtc

SEQ ID NO: 348 - DNA, 6 bp, Artificial Sequence
  oligonucleotide patterns over-represented in STAR elements
cgacca

SEQ ID NO: 349 - DNA, 6 bp, Artificial Sequence
  oligonucleotide patterns over-represented in STAR elements
atgacg

SEQ ID NO: 350 - DNA, 6 bp, Artificial Sequence
  oligonucleotide patterns over-represented in STAR elements
ccatcg

SEQ ID NO: 351 - DNA, 6 bp, Artificial Sequence
  oligonucleotide patterns over-represented in STAR elements
agggga

SEQ ID NO: 352 - DNA, 6 bp, Artificial Sequence
  oligonucleotide patterns over-represented in STAR elements
gctgca

SEQ ID NO: 353 - DNA, 6 bp, Artificial Sequence
  oligonucleotide patterns over-represented in STAR elements
acccca

SEQ ID NO: 354 - DNA, 6 bp, Artificial Sequence
  oligonucleotide patterns over-represented in STAR elements
cggagc

SEQ ID NO: 355 - DNA, 6 bp, Artificial Sequence
  oligonucleotide patterns over-represented in STAR elements
cctccg

SEQ ID NO: 356 - DNA, 6 bp, Artificial Sequence
  oligonucleotide patterns over-represented in STAR elements
cgggac

SEQ ID NO: 357 - DNA, 6 bp, Artificial Sequence
  oligonucleotide patterns over-represented in STAR elements
cctgga

SEQ ID NO: 358 - DNA, 6 bp, Artificial Sequence
  oligonucleotide patterns over-represented in STAR elements
aggcga

SEQ ID NO: 359 - DNA, 6 bp, Artificial Sequence
  oligonucleotide patterns over-represented in STAR elements
acccct

SEQ ID NO: 360 - DNA, 6 bp, Artificial Sequence
  oligonucleotide patterns over-represented in STAR elements
gctccc

SEQ ID NO: 361 - DNA, 6 bp, Artificial Sequence
  oligonucleotide patterns over-represented in STAR elements
cgtcac

SEQ ID NO: 362 - DNA, 6 bp, Artificial Sequence
  oligonucleotide patterns over-represented in STAR elements
agcgca

SEQ ID NO: 363 - DNA, 6 bp, Artificial Sequence
  oligonucleotide patterns over-represented in STAR elements
gaagcc

SEQ ID NO: 364 - DNA, 6 bp, Artificial Sequence
  oligonucleotide patterns over-represented in STAR elements
gaggcc

SEQ ID NO: 365 - DNA, 6 bp, Artificial Sequence
  oligonucleotide patterns over-represented in STAR elements
accctc

SEQ ID NO: 366 - DNA, 6 bp, Artificial Sequence
  oligonucleotide patterns over-represented in STAR elements
cccggc

SEQ ID NO: 367 - DNA, 6 bp, Artificial Sequence
  oligonucleotide patterns over-represented in STAR elements
cgagaa

SEQ ID NO: 368 - DNA, 6 bp, Artificial Sequence
  oligonucleotide patterns over-represented in STAR elements
ccaccg

SEQ ID NO: 369 - DNA, 6 bp, Artificial Sequence
  oligonucleotide patterns over-represented in STAR elements
acttcg

SEQ ID NO: 370 - DNA, 6 bp, Artificial Sequence
  oligonucleotide patterns over-represented in STAR elements
gatgac

SEQ ID NO: 371 - DNA, 6 bp, Artificial Sequence
  oligonucleotide patterns over-represented in STAR elements
acgagg

SEQ ID NO: 372 - DNA, 6 bp, Artificial Sequence
  oligonucleotide patterns over-represented in STAR elements
ccggag

SEQ ID NO: 373 - DNA, 6 bp, Artificial Sequence
  oligonucleotide patterns over-represented in STAR elements
acccac

SEQ ID NO: 374 - DNA, 6 bp, Artificial Sequence
  oligonucleotide patterns over-represented in STAR elements
ctgggc

SEQ ID NO: 375 - DNA, 6 bp, Artificial Sequence
  oligonucleotide patterns over-represented in STAR elements
ccacgg

SEQ ID NO: 376 - DNA, 6 bp, Artificial Sequence
  oligonucleotide patterns over-represented in STAR elements
cggtcc

SEQ ID NO: 377 - DNA, 6 bp, Artificial Sequence
  oligonucleotide patterns over-represented in STAR elements
agcacc

SEQ ID NO: 378 - DNA, 6 bp, Artificial Sequence
  oligonucleotide patterns over-represented in STAR elements
acaccc

SEQ ID NO: 379 - DNA, 6 bp, Artificial Sequence
  oligonucleotide patterns over-represented in STAR elements
agggcc

SEQ ID NO: 380 - DNA, 6 bp, Artificial Sequence
  oligonucleotide patterns over-represented in STAR elements
cgcgaa

SEQ ID NO: 381 - DNA, 6 bp, Artificial Sequence
  oligonucleotide patterns over-represented in STAR elements
gagccc

SEQ ID NO: 382 - DNA, 6 bp, Artificial Sequence
  oligonucleotide patterns over-represented in STAR elements
ctgagc

SEQ ID NO: 383 - DNA, 6 bp, Artificial Sequence
  oligonucleotide patterns over-represented in STAR elements
aatcgg

SEQ ID NO: 384 - DNA, 8 bp, Artificial Sequence
  Dyad patterns over-represented in STAR elements
  misc_feature (4)..(5): "N" stands for any nucleotide
cccnncgg

SEQ ID NO: 385 - DNA, 12 bp, Artificial Sequence
  Dyad patterns over-represented in STAR elements
  misc_feature (4)..(9): "N" stands for any nucleotide
ccgnnnnnnccc

SEQ ID NO: 386 - DNA, 6 bp, Artificial Sequence
  Dyad patterns over-represented in STAR elements
cagcgg

SEQ ID NO: 387 - DNA, 21 bp, Artificial Sequence
  Dyad patterns over-represented in STAR elements
  misc_feature (4)..(18): "N" stands for any nucleotide
cgcnnnnnnnnnnnnnnnccc

SEQ ID NO: 388 - DNA, 15 bp, Artificial Sequence
  Dyad patterns over-represented in STAR elements
  misc_feature (4)..(12): "N" stands for any nucleotide
cggnnnnnnnnngcc

SEQ ID NO: 389 - DNA, 15 bp, Artificial Sequence
  Dyad patterns over-represented in STAR elements
  misc_feature (4)..(12): "N" stands for any nucleotide
cccnnnnnnnnncgc

SEQ ID NO: 390 - DNA, 7 bp, Artificial Sequence
  Dyad patterns over-represented in STAR elements
  misc_feature (4)..(4): "N" stands for any nucleotide
cccngcg

SEQ ID NO: 391 - DNA, 6 bp, Artificial Sequence
  Dyad patterns over-represented in STAR elements
ccccac

SEQ ID NO: 392 - DNA, 22 bp, Artificial Sequence
  Dyad patterns over-represented in STAR elements
  misc_feature (4)..(19): "N" stands for any nucleotide
agcnnnnnnnnnnnnnnnnccg

SEQ ID NO: 393 - DNA, 10 bp, Artificial Sequence
  Dyad patterns over-represented in STAR elements
  misc_feature (4)..(7): "N" stands for any nucleotide
cccnnnncgc

SEQ ID NO: 394 - DNA, 19 bp, Artificial Sequence
  Dyad patterns over-represented in STAR elements
  misc_feature (4)..(16): "N" stands for any nucleotide
cgcnnnnnnnnnnnnngga

SEQ ID NO: 395 - DNA, 22 bp, Artificial Sequence
  Dyad patterns over-represented in STAR elements
  misc_feature (4)..(19): "N" stands for any nucleotide
gcgnnnnnnnnnnnnnnnnccc

SEQ ID NO: 396 - DNA, 11 bp, Artificial Sequence
  Dyad patterns over-represented in STAR elements
  misc_feature (4)..(8): "N" stands for any nucleotide
cgcnnnnngca

SEQ ID NO: 397 - DNA, 20 bp, Artificial Sequence
  Dyad patterns over-represented in STAR elements
  misc_feature (4)..(17): "N" stands for any nucleotide
cccnnnnnnnnnnnnnnccc

SEQ ID NO: 398 - DNA, 10 bp, Artificial Sequence
  Dyad patterns over-represented in STAR elements
  misc_feature (4)..(7): "N" stands for any nucleotide
ctgnnnncgc

SEQ ID NO: 399 - DNA, 18 bp, Artificial Sequence
  Dyad patterns over-represented in STAR elements
  misc_feature (4)..(15): "N" stands for any nucleotide
ccannnnnnnnnnnngcg

SEQ ID NO: 400 - DNA, 17 bp, Artificial Sequence
  Dyad patterns over-represented in STAR elements
  misc_feature (4)..(14): "N" stands for any nucleotide
cggnnnnnnnnnnncag

SEQ ID NO: 401 - DNA, 11 bp, Artificial Sequence
  Dyad patterns over-represented in STAR elements
  misc_feature (4)..(8): "N" stands for any nucleotide
cccnnnnngcc

SEQ ID NO: 402 - DNA, 6 bp, Artificial Sequence
  Dyad patterns over-represented in STAR elements
gccccc

SEQ ID NO: 403 - DNA, 10 bp, Artificial Sequence
  Dyad patterns over-represented in STAR elements
  misc_feature (4)..(7): "N" stands for any nucleotide
cgcnnnngac

SEQ ID NO: 404 - DNA, 6 bp, Artificial Sequence
  Dyad patterns over-represented in STAR elements
cggcag

SEQ ID NO: 405 - DNA, 9 bp, Artificial Sequence
  Dyad patterns over-represented in STAR elements
  misc_feature (4)..(6): "N" stands for any nucleotide
cccnnncgc

SEQ ID NO: 406 - DNA, 7 bp, Artificial Sequence
  Dyad patterns over-represented in STAR elements
  misc_feature (4)..(4): "N" stands for any nucleotide
cgcngac

SEQ ID NO: 407 - DNA, 8 bp, Artificial Sequence
  Dyad patterns over-represented in STAR elements
  misc_feature (4)..(5): "N" stands for any nucleotide
gcgnngcc

SEQ ID NO: 408 - DNA, 10 bp, Artificial Sequence
  Dyad patterns over-represented in STAR elements
  misc_feature (4)..(7): "N" stands for any nucleotide
cccnnnngcc

SEQ ID NO: 409 - DNA, 7 bp, Artificial Sequence
  Dyad patterns over-represented in STAR elements
  misc_feature (4)..(4): "N" stands for any nucleotide
cccnccc

SEQ ID NO: 410 - DNA, 19 bp, Artificial Sequence
  Dyad patterns over-represented in STAR elements
  misc_feature (4)..(16): "N" stands for any nucleotide
ccgnnnnnnnnnnnnncag

SEQ ID NO: 411 - DNA, 10 bp, Artificial Sequence
  Dyad patterns over-represented in STAR elements
  misc_feature (4)..(7): "N" stands for any nucleotide
gccnnnngga

SEQ ID NO: 412 - DNA, 9 bp, Artificial Sequence
  Dyad patterns over-represented in STAR elements
  misc_feature (4)..(6): "N" stands for any nucleotide
ccgnnngga

SEQ ID NO: 413 - DNA, 8 bp, Artificial Sequence
  Dyad patterns over-represented in STAR elements
  misc_feature (4)..(5): "N" stands for any nucleotide
aggnnggg

SEQ ID NO: 414 - DNA, 11 bp, Artificial Sequence
  Dyad patterns over-represented in STAR elements
  misc_feature (4)..(8): "N" stands for any nucleotide
cacnnnnngcg

SEQ ID NO: 415 - DNA, 23 bp, Artificial Sequence
  Dyad patterns over-represented in STAR elements
  misc_feature (4)..(20): "N" stands for any nucleotide
cgcnnnnnnnnnnnnnnnnncca

SEQ ID NO: 416 - DNA, 15 bp, Artificial Sequence
  Dyad patterns over-represented in STAR elements
  misc_feature (4)..(12): "N" stands for any nucleotide
cccnnnnnnnnnggc

SEQ ID NO: 417 - DNA, 11 bp, Artificial Sequence
  Dyad patterns over-represented in STAR elements
  misc_feature (4)..(8): "N" stands for any nucleotide
cctnnnnngcg

SEQ ID NO: 418 - DNA, 6 bp, Artificial Sequence
  Dyad patterns over-represented in STAR elements
gcggac

SEQ ID NO: 419 - DNA, 6 bp, Artificial Sequence
  Dyad patterns over-represented in STAR elements
gccggc

SEQ ID NO: 420 - DNA, 8 bp, Artificial Sequence
  Dyad patterns over-represented in STAR elements
  misc_feature (4)..(5): "N" stands for any nucleotide
gcgnnccc

SEQ ID NO: 421 - DNA, 17 bp, Artificial Sequence
  Dyad patterns over-represented in STAR elements
  misc_feature (4)..(14): "N" stands for any nucleotide
ccgnnnnnnnnnnnccc

SEQ ID NO: 422 - DNA, 14 bp, Artificial Sequence
  Dyad patterns over-represented in STAR elements
  misc_feature (4)..(11): "N" stands for any nucleotide
cccnnnnnnnntcg

SEQ ID NO: 423 - DNA, 23 bp, Artificial Sequence
  Dyad patterns over-represented in STAR elements
  misc_feature (4)..(20): "N" stands for any nucleotide
ccgnnnnnnnnnnnnnnnnngcc

SEQ ID NO: 424 - DNA, 11 bp, Artificial Sequence
  Dyad patterns over-represented in STAR elements
  misc_feature (4)..(8): "N" stands for any nucleotide
gggnnnnngga

SEQ ID NO: 425 - DNA, 12 bp, Artificial Sequence
  Dyad patterns over-represented in STAR elements
  misc_feature (4)..(9): "N" stands for any nucleotide
ggcnnnnnngga

SEQ ID NO: 426 - DNA, 10 bp, Artificial Sequence
  Dyad patterns over-represented in STAR elements
  misc_feature (4)..(7): "N" stands for any nucleotide
ccannnnccc

SEQ ID NO: 427 - DNA, 20 bp, Artificial Sequence
  Dyad patterns over-represented in STAR elements
  misc_feature (4)..(17): "N" stands for any nucleotide
cctnnnnnnnnnnnnnnccg

SEQ ID NO: 428 - DNA, 18 bp, Artificial Sequence
  Dyad patterns over-represented in STAR elements
  misc_feature (4)..(15): "N" stands for any nucleotide
gacnnnnnnnnnnnnggc

SEQ ID NO: 429 - DNA, 19 bp, Artificial Sequence
  Dyad patterns over-represented in STAR elements
  misc_feature (4)..(16): "N" stands for any nucleotide
cgcnnnnnnnnnnnnnccc

SEQ ID NO: 430 - DNA, 22 bp, Artificial Sequence
  Dyad patterns over-represented in STAR elements
  misc_feature (4)..(19): "N" stands for any nucleotide
cagnnnnnnnnnnnnnnnnccc

SEQ ID NO: 431 - DNA, 16 bp, Artificial Sequence
  Dyad patterns over-represented in STAR elements
  misc_feature (4)..(13): "N" stands for any nucleotide
agcnnnnnnnnnnggg

SEQ ID NO: 432 - DNA, 19 bp, Artificial Sequence
  Dyad patterns over-represented in STAR elements
  misc_feature (4)..(16): "N" stands for any nucleotide
cggnnnnnnnnnnnnnggc

SEQ ID NO: 433 - DNA, 7 bp, Artificial Sequence
  Dyad patterns over-represented in STAR elements
  misc_feature (4)..(4): "N" stands for any nucleotide
cggngcc

SEQ ID NO: 434 - DNA, 6 bp, Artificial Sequence
  Dyad patterns over-represented in STAR elements
agcggc

SEQ ID NO: 435 - DNA, 22 bp, Artificial Sequence
  Dyad patterns over-represented in STAR elements
  misc_feature (4)..(19): "N" stands for any nucleotide
cccnnnnnnnnnnnnnnnnggc

SEQ ID NO: 436 - DNA, 25 bp, Artificial Sequence
  Dyad patterns over-represented in STAR elements
  misc_feature (4)..(22): "N" stands for any nucleotide
gctnnnnnnnnnnnnnnnnnnnccc

SEQ ID NO: 437 - DNA, 22 bp, Artificial Sequence
  Dyad patterns over-represented in STAR elements
  misc_feature (4)..(19): "N" stands for any nucleotide
cccnnnnnnnnnnnnnnnnggg

SEQ ID NO: 438 - DNA, 15 bp, Artificial Sequence
  Dyad patterns over-represented in STAR elements
  misc_feature (4)..(12): "N" stands for any nucleotide
cccnnnnnnnnncgg

SEQ ID NO: 439 - DNA, 16 bp, Artificial Sequence
  Dyad patterns over-represented in STAR elements
  misc_feature (4)..(13): "N" stands for any nucleotide
cccnnnnnnnnnncgg

SEQ ID NO: 440 - DNA, 6 bp, Artificial Sequence
  Dyad patterns over-represented in STAR elements
ccagcg

SEQ ID NO: 441 - DNA, 23 bp, Artificial Sequence
  Dyad patterns over-represented in STAR elements
  misc_feature (4)..(20): "N" stands for any nucleotide
gccnnnnnnnnnnnnnnnnncgc

SEQ ID NO: 442 - DNA, 12 bp, Artificial Sequence
  Dyad patterns over-represented in STAR elements
  misc_feature (4)..(9): "N" stands for any nucleotide
cctnnnnnncgc

SEQ ID NO: 443 - DNA, 7 bp, Artificial Sequence
  Dyad patterns over-represented in STAR elements
  misc_feature (4)..(4): "N" stands for any nucleotide
gganccc

SEQ ID NO: 444 - DNA, 24 bp, Artificial Sequence
  Dyad patterns over-represented in STAR elements
  misc_feature (4)..(21): "N" stands for any nucleotide
cgcnnnnnnnnnnnnnnnnnncac

SEQ ID NO: 445 - DNA, 26 bp, Artificial Sequence
  Dyad patterns over-represented in STAR elements
  misc_feature (4)..(23): "N" stands for any nucleotide
cgcnnnnnnnnnnnnnnnnnnnnccg

SEQ ID NO: 446 - DNA, 6 bp, Artificial Sequence
  Dyad patterns over-represented in STAR elements
ccggca

SEQ ID NO: 447 - DNA, 26 bp, Artificial Sequence
  Dyad patterns over-represented in STAR elements
  misc_feature (4)..(23): "N" stands for any nucleotide
cgcnnnnnnnnnnnnnnnnnnnnccc

SEQ ID NO: 448 - DNA, 21 bp, Artificial Sequence
  Dyad patterns over-represented in STAR elements
  misc_feature (4)..(18): "N" stands for any nucleotide
agcnnnnnnnnnnnnnnnccc

SEQ ID NO: 449 - DNA, 13 bp, Artificial Sequence
  Dyad patterns over-represented in STAR elements
  misc_feature (4)..(10): "N" stands for any nucleotide
cctnnnnnnnggc

SEQ ID NO: 450 - DNA, 11 bp, Artificial Sequence
  Dyad patterns over-represented in STAR elements
  misc_feature (4)..(8): "N" stands for any nucleotide
gccnnnnncgc

SEQ ID NO: 451 - DNA, 20 bp, Artificial Sequence
  Dyad patterns over-represented in STAR elements
  misc_feature (4)..(17): "N" stands for any nucleotide
gccnnnnnnnnnnnnnncgc

SEQ ID NO: 452 - DNA, 17 bp, Artificial Sequence
  Dyad patterns over-represented in STAR elements
  misc_feature (4)..(14): "N" stands for any nucleotide
cagnnnnnnnnnnnccc

SEQ ID NO: 453 - DNA, 22 bp, Artificial Sequence
  Dyad patterns over-represented in STAR elements
  misc_feature (4)..(19): "N" stands for any nucleotide
gggnnnnnnnnnnnnnnnngac

SEQ ID NO: 454 - DNA, 21 bp, Artificial Sequence
  Dyad patterns over-represented in STAR elements
  misc_feature (4)..(18): "N" stands for any nucleotide
cccnnnnnnnnnnnnnnngcg

SEQ ID NO: 455 - DNA, 6 bp, Artificial Sequence
  Dyad patterns over-represented in STAR elements
ccccgc

SEQ ID NO: 456 - DNA, 22 bp, Artificial Sequence
  Dyad patterns over-represented in STAR elements
  misc_feature (4)..(19): "N" stands for any nucleotide
cccnnnnnnnnnnnnnnnnagc

SEQ ID NO: 457 - DNA, 15 bp, Artificial Sequence
  Dyad patterns over-represented in STAR elements
  misc_feature (4)..(12): "N" stands for any nucleotide
aggnnnnnnnnnggg

SEQ ID NO: 458 - DNA, 18 bp, Artificial Sequence
  Dyad patterns over-represented in STAR elements
  misc_feature (4)..(18): "N" stands for any nucleotide
cgcnnnnnnnnnnnnctc

SEQ ID NO: 459 - DNA, 14 bp, Artificial Sequence
  Dyad patterns over-represented in STAR elements
  misc_feature (4)..(11): "N" stands for any nucleotide
cacnnnnnnnncgc

SEQ ID NO: 460 - DNA, 13 bp, Artificial Sequence
  Dyad patterns over-represented in STAR elements
  misc_feature (4)..(10): "N" stands for any nucleotide
ccannnnnnnccg

SEQ ID NO: 461 - DNA, 7 bp, Artificial Sequence
  Dyad patterns over-represented in STAR elements
  misc_feature (4)..(4): "N" stands for any nucleotide
cggngca

SEQ ID NO: 462 - DNA, 20 bp, Artificial Sequence
  Dyad patterns over-represented in STAR elements
  misc_feature (4)..(17): "N" stands for any nucleotide
cgcnnnnnnnnnnnnnnccc

SEQ ID NO: 463 - DNA, 6 bp, Artificial Sequence
  Dyad patterns over-represented in STAR elements
agcccc

SEQ ID NO: 464 - DNA, 19 bp, Artificial Sequence
  Dyad patterns over-represented in STAR elements
  misc_feature (4)..(16): "N" stands for any nucleotide
cgcnnnnnnnnnnnnngtc

SEQ ID NO: 465 - DNA, 9 bp, Artificial Sequence
  Dyad patterns over-represented in STAR elements
  misc_feature (4)..(6): "N" stands for any nucleotide
gcgnnngca

SEQ ID NO: 466 - DNA, 6 bp, Artificial Sequence
  Dyad patterns over-represented in STAR elements
cggggc

SEQ ID NO: 467 - DNA, 20 bp, Artificial Sequence
  Dyad patterns over-represented in STAR elements
  misc_feature (4)..(17): "N" stands for any nucleotide
gccnnnnnnnnnnnnnnccc

SEQ ID NO: 468 - DNA, 13 bp, Artificial Sequence
  Dyad patterns over-represented in STAR elements
  misc_feature (4)..(10): "N" stands for any nucleotide
accnnnnnnncgc

SEQ ID NO: 469 - DNA, 13 bp, Artificial Sequence
  Dyad patterns over-represented in STAR elements
  misc_feature (4)..(10): "N" stands for any nucleotide
aggnnnnnnncgg

SEQ ID NO: 470 - DNA, 22 bp, Artificial Sequence
  Dyad patterns over-represented in STAR elements
  misc_feature (4)..(19): "N" stands for any nucleotide
cccnnnnnnnnnnnnnnnncga

SEQ ID NO: 471 - DNA, 12 bp, Artificial Sequence
  Dyad patterns over-represented in STAR elements
  misc_feature (4)..(9): "N" stands for any nucleotide
cgcnnnnnncag

SEQ ID NO: 472 - DNA, 17 bp, Artificial Sequence
  Dyad patterns over-represented in STAR elements
  misc_feature (4)..(14): "N" stands for any nucleotide
cagnnnnnnnnnnngcg

SEQ ID NO: 473 - DNA, 18 bp, Artificial Sequence
  Dyad patterns over-represented in STAR elements
  misc_feature (4)..(15): "N" stands for any nucleotide
ccgnnnnnnnnnnnnccg

SEQ ID NO: 474 - DNA, 24 bp, Artificial Sequence
  Dyad patterns over-represented in STAR elements
  misc_feature (4)..(21): "N" stands for any nucleotide
cgcnnnnnnnnnnnnnnnnnncag

SEQ ID NO: 475 - DNA, 7 bp, Artificial Sequence
  Dyad patterns over-represented in STAR elements
  misc_feature (4)..(4): "N" stands for any nucleotide
cagnggg

SEQ ID NO: 476 - DNA, 6 bp, Artificial Sequence
  Dyad patterns over-represented in STAR elements
cgcccc

SEQ ID NO: 477 - DNA, 24 bp, Artificial Sequence
  Dyad patterns over-represented in STAR elements
  misc_feature (4)..(21): "N" stands for any nucleotide
gcgnnnnnnnnnnnnnnnnnngcc

SEQ ID NO: 478 - DNA, 21 bp, Artificial Sequence
  Dyad patterns over-represented in STAR elements
  misc_feature (4)..(18): "N" stands for any nucleotide
cggnnnnnnnnnnnnnnnggc

SEQ ID NO: 479 - DNA, 21 bp, Artificial Sequence
  Dyad patterns over-represented in STAR elements
  misc_feature (4)..(18): "N" stands for any nucleotide
cccnnnnnnnnnnnnnnnagg

SEQ ID NO: 480 - DNA, 26 bp, Artificial Sequence
  Dyad patterns over-represented in STAR elements
  misc_feature (4)..(23): "N" stands for any nucleotide
aggnnnnnnnnnnnnnnnnnnnngcg

SEQ ID NO: 481 - DNA, 11 bp, Artificial Sequence
  Dyad patterns over-represented in STAR elements
  misc_feature (4)..(8): "N" stands for any nucleotide
cggnnnnnctc

SEQ ID NO: 482 - DNA, 23 bp, Artificial Sequence
  Dyad patterns over-represented in STAR elements
  misc_feature (4)..(20): "N" stands for any nucleotide
tccnnnnnnnnnnnnnnnnncga

SEQ ID NO: 483 - DNA, 10 bp, Artificial Sequence
  Dyad patterns over-represented in STAR elements
  misc_feature (4)..(7): "N" stands for any nucleotide
gcgnnnnccc

SEQ ID NO: 484 - DNA, 8 bp, Artificial Sequence
  Dyad patterns over-represented in STAR elements
  misc_feature (4)..(5): "N" stands for any nucleotide
cccnncgc

SEQ ID NO: 485 - DNA, 9 bp, Artificial Sequence
  Dyad patterns over-represented in STAR elements
  misc_feature (4)..(6): "N" stands for any nucleotide
cgtnnncag

SEQ ID NO: 486 - DNA, 19 bp, Artificial Sequence
  Dyad patterns over-represented in STAR elements
  misc_feature (4)..(16): "N" stands for any nucleotide
ccgnnnnnnnnnnnnngag

SEQ ID NO: 487 - DNA, 12 bp, Artificial Sequence
  Dyad patterns over-represented in STAR elements
  misc_feature (4)..(9): "N" stands for any nucleotide
ctcnnnnnncgc

SEQ ID NO: 488 - DNA, 10 bp, Artificial Sequence
  Dyad patterns over-represented in STAR elements
  misc_feature (4)..(7): "N" stands for any nucleotide
cgcnnnngag

SEQ ID NO: 489 - DNA, 11 bp, Artificial Sequence
  Dyad patterns over-represented in STAR elements
  misc_feature (4)..(8): "N" stands for any nucleotide
gcgnnnnngga

SEQ ID NO: 490 - DNA, 7 bp, Artificial Sequence
  Dyad patterns over-represented in STAR elements
  misc_feature (4)..(4): "N" stands for any nucleotide
ccgncag

SEQ ID NO: 491 - DNA, 17 bp, Artificial Sequence
  Dyad patterns over-represented in STAR elements
  misc_feature (4)..(14): "N" stands for any nucleotide
cgcnnnnnnnnnnnccg

SEQ ID NO: 492 - DNA, 25 bp, Artificial Sequence
  Dyad patterns over-represented in STAR elements
  misc_feature (4)..(22): "N" stands for any nucleotide
gcgnnnnnnnnnnnnnnnnnnnccc

SEQ ID NO: 493 - DNA, 24 bp, Artificial Sequence
  Dyad patterns over-represented in STAR elements
  misc_feature (4)..(21): "N" stands for any nucleotide
cgcnnnnnnnnnnnnnnnnnngaa

SEQ ID NO: 494 - DNA, 25 bp, Artificial Sequence
  Dyad patterns over-represented in STAR elements
  misc_feature (4)..(22): "N" stands for any nucleotide
gggnnnnnnnnnnnnnnnnnnngga

SEQ ID NO: 495 - DNA, 7 bp, Artificial Sequence
  Dyad patterns over-represented in STAR elements
  misc_feature (4)..(4): "N" stands for any nucleotide
ccancgg

SEQ ID NO: 496 - DNA, 13 bp, Artificial Sequence
  Dyad patterns over-represented in STAR elements
  misc_feature (4)..(10): "N" stands for any nucleotide
cccnnnnnnngcg

SEQ ID NO: 497 - DNA, 16 bp, Artificial Sequence
  Dyad patterns over-represented in STAR elements
  misc_feature (4)..(13): "N" stands for any nucleotide
aggnnnnnnnnnnccc

SEQ ID NO: 498 - DNA, 6 bp, Artificial Sequence
  Dyad patterns over-represented in STAR elements
ccaggg

SEQ ID NO: 499 - DNA, 16 bp, Artificial Sequence
  Dyad patterns over-represented in STAR elements
  misc_feature (4)..(13): "N" stands for any nucleotide
cagnnnnnnnnnnccc

SEQ ID NO: 500 - DNA, 24 bp, Artificial Sequence
  Dyad patterns over-represented in STAR elements
  misc_feature (4)..(21): "N" stands for any nucleotide
ccgnnnnnnnnnnnnnnnnnnccg

SEQ ID NO: 501 - DNA, 24 bp, Artificial Sequence
  Dyad patterns over-represented in STAR elements
  misc_feature (4)..(21): "N" stands for any nucleotide
ccgnnnnnnnnnnnnnnnnnnggc

SEQ ID NO: 502 - DNA, 8 bp, Artificial Sequence
  Dyad patterns over-represented in STAR elements
  misc_feature (4)..(5): "N" stands for any nucleotide
cccnngcg

SEQ ID NO: 503 - DNA, 7 bp, Artificial Sequence
  Dyad patterns over-represented in STAR elements
  misc_feature (4)..(5): "N" stands for any nucleotide
cgcnggc

SEQ ID NO: 504 - DNA, 11 bp, Artificial Sequence
  Dyad patterns over-represented in STAR elements
  misc_feature (4)..(8): "N" stands for any nucleotide
ccgnnnnngac

SEQ ID NO: 505 - DNA, 6 bp, Artificial Sequence
  Dyad patterns over-represented in STAR elements
ggaccc

SEQ ID NO: 506 - DNA, 7 bp, Artificial Sequence
  Dyad patterns over-represented in STAR elements
  misc_feature (4)..(4): "N" stands for any nucleotide
cccnccg

SEQ ID NO: 507 - DNA, 21 bp, Artificial Sequence
  Dyad patterns over-represented in STAR elements
  misc_feature (4)..(18): "N" stands for any nucleotide
cccnnnnnnnnnnnnnnnacg

SEQ ID NO: 508 - DNA, 14 bp, Artificial Sequence
  Dyad patterns over-represented in STAR elements
  misc_feature (4)..(11): "N" stands for any nucleotide
agcnnnnnnnnccc

SEQ ID NO: 509 - DNA, 9 bp, Artificial Sequence
  Dyad patterns over-represented in STAR elements
  misc_feature (4)..(6): "N" stands for any nucleotide
cccnnnggc

SEQ ID NO: 510 - DNA, 15 bp, Artificial Sequence
  Dyad patterns over-represented in STAR elements
  misc_feature (4)..(12): "N" stands for any nucleotide
aggnnnnnnnnncgg

SEQ ID NO: 511 - DNA, 20 bp, Artificial Sequence
  Dyad patterns over-represented in STAR elements
  misc_feature (4)..(17): "N" stands for any nucleotide
cccnnnnnnnnnnnnnncgc

SEQ ID NO: 512 - DNA, 6 bp, Artificial Sequence
  Dyad patterns over-represented in STAR elements
ccgccg

SEQ ID NO: 513 - DNA, 14 bp, Artificial Sequence
  Dyad patterns over-represented in STAR elements
  misc_feature (4)..(11): "N" stands for any nucleotide
cgcnnnnnnnnagc

SEQ ID NO: 514 - DNA, 25 bp, Artificial Sequence
  Dyad patterns over-represented in STAR elements
  misc_feature (4)..(22): "N" stands for any nucleotide
cgcnnnnnnnnnnnnnnnnnnnacc

SEQ ID NO: 515 - DNA, 23 bp, Artificial Sequence
  Dyad patterns over-represented in STAR elements
  misc_feature (4)..(20): "N" stands for any nucleotide
gcgnnnnnnnnnnnnnnnnngac

SEQ ID NO: 516 - DNA, 7 bp, Artificial Sequence
  Dyad patterns over-represented in STAR elements
  misc_feature (4)..(4): "N" stands for any nucleotide
agcngcg

SEQ ID NO: 517 - DNA, 17 bp, Artificial Sequence
  Dyad patterns over-represented in STAR elements
  misc_feature (4)..(14): "N" stands for any nucleotide
ccgnnnnnnnnnnnggc

SEQ ID NO: 518 - DNA, 10 bp, Artificial Sequence
  Dyad patterns over-represented in STAR elements
  misc_feature (4)..(7): "N" stands for any nucleotide
cggnnnnaga

SEQ ID NO: 519 - DNA, 20 bp, Artificial Sequence
  Dyad patterns over-represented in STAR elements
  misc_feature (4)..(17): "N" stands for any nucleotide
cgcnnnnnnnnnnnnnnccg

SEQ ID NO: 520 - DNA, 26 bp, Artificial Sequence
  Dyad patterns over-represented in STAR elements
  misc_feature (4)..(23): "N" stands for any nucleotide
cctnnnnnnnnnnnnnnnnnnnngcg

SEQ ID NO: 521 - DNA, 16 bp, Artificial Sequence
  Dyad patterns over-represented in STAR elements
  misc_feature (4)..(13): "N" stands for any nucleotide
ccannnnnnnnnncgc

SEQ ID NO: 522 - DNA, 26 bp, Artificial Sequence
  Dyad patterns over-represented in STAR elements
  misc_feature (4)..(23): "N" stands for any nucleotide
cccnnnnnnnnnnnnnnnnnnnncac

SEQ ID NO: 523 - DNA, 17 bp, Artificial Sequence
  Dyad patterns over-represented in STAR elements
  misc_feature (4)..(14): "N" stands for any nucleotide
ccgnnnnnnnnnnngcc

SEQ ID NO: 524 - DNA, 24 bp, Artificial Sequence
  Dyad patterns over-represented in STAR elements
  misc_feature (4)..(21): "N" stands for any nucleotide
cgcnnnnnnnnnnnnnnnnnnccc

SEQ ID NO: 525 - DNA, 21 bp, Artificial Sequence
  Dyad patterns over-represented in STAR elements
  misc_feature (4)..(18): "N" stands for any nucleotide
cggnnnnnnnnnnnnnnncgc

SEQ ID NO: 526 - DNA, 22 bp, Artificial Sequence
  Dyad patterns over-represented in STAR elements
  misc_feature (4)..(19): "N" stands for any nucleotide
cgcnnnnnnnnnnnnnnnngcc

SEQ ID NO: 527 - DNA, 26 bp, Artificial Sequence
  Dyad patterns over-represented in STAR elements
  misc_feature (4)..(23): "N" stands for any nucleotide
cgcnnnnnnnnnnnnnnnnnnnnggc

SEQ ID NO: 528 - DNA, 25 bp, Artificial Sequence
  Dyad patterns over-represented in STAR elements
  misc_feature (4)..(22): "N" stands for any nucleotide
cgcnnnnnnnnnnnnnnnnnnnccg

SEQ ID NO: 529 - DNA, 16 bp, Artificial Sequence
  Dyad patterns over-represented in STAR elements
  misc_feature (4)..(13): "N" stands for any nucleotide
cggnnnnnnnnnncca

SEQ ID NO: 530 - DNA, 23 bp, Artificial Sequence
  Dyad patterns over-represented in STAR elements
  misc_feature (4)..(20): "N" stands for any nucleotide
cgcnnnnnnnnnnnnnnnnnccc

SEQ ID NO: 531 - DNA, 17 bp, Artificial Sequence
  Dyad patterns over-represented in STAR elements
  misc_feature (4)..(14): "N" stands for any nucleotide
cgcnnnnnnnnnnnaca

SEQ ID NO: 532 - DNA, 6 bp, Artificial Sequence
  Dyad patterns over-represented in STAR elements
cggacc

SEQ ID NO: 533 - DNA, 16 bp, Artificial Sequence
  Dyad patterns over-represented in STAR elements
  misc_feature (4)..(13): "N" stands for any nucleotide
gcgnnnnnnnnnngcc

SEQ ID NO: 534 - DNA, 14 bp, Artificial Sequence
  Dyad patterns over-represented in STAR elements
  misc_feature (4)..(11): "N" stands for any nucleotide
gcgnnnnnnnngac

SEQ ID NO: 535 - DNA, 21 bp, Artificial Sequence
  Dyad patterns over-represented in STAR elements
  misc_feature (4)..(18): "N" stands for any nucleotide
cccnnnnnnnnnnnnnnnggg

SEQ ID NO: 536 - DNA, 22 bp, Artificial Sequence
  Dyad patterns over-represented in STAR elements
  misc_feature (1)..(19): "N" stands for any nucleotide
cggnnnnnnnnnnnnnnnnggc

SEQ ID NO: 537 - DNA, 22 bp, Artificial Sequence
  Dyad patterns over-represented in STAR elements
  misc_feature (4)..(19): "N" stands for any nucleotide
cgcnnnnnnnnnnnnnnnncca

SEQ ID NO: 538 - DNA, 9 bp, Artificial Sequence
  Dyad patterns over-represented in STAR elements
  misc_feature (4)..(6): "N" stands for any nucleotide
gccnnnccc

SEQ ID NO: 539 - DNA, 10 bp, Artificial Sequence
  Dyad patterns over-represented in STAR elements
  misc_feature (4)..(7): "N" stands for any nucleotide
cagnnnnggg

SEQ ID NO: 540 - DNA, 12 bp, Artificial Sequence
  Dyad patterns over-represented in STAR elements
  misc_feature (4)..(9): "N" stands for any nucleotide
cccnnnnnngcg

SEQ ID NO: 541 - DNA, 22 bp, Artificial Sequence
  Dyad patterns over-represented in STAR elements
  misc_feature (4)..(19): "N" stands for any nucleotide
ccgnnnnnnnnnnnnnnnncgc

SEQ ID NO: 542 - DNA, 23 bp, Artificial Sequence
  Dyad patterns over-represented in STAR elements
  misc_feature (4)..(20): "N" stands for any nucleotide
cccnnnnnnnnnnnnnnnnngca

SEQ ID NO: 543 - DNA, 19 bp, Artificial Sequence
  Dyad patterns over-represented in STAR elements
  misc_feature (4)..(16): "N" stands for any nucleotide
cgcnnnnnnnnnnnnntcc

SEQ ID NO: 544 - DNA, 7 bp, Artificial Sequence
  Dyad patterns over-represented in STAR elements
  misc_feature (4)..(4): "N" stands for any nucleotide
gccncgc

SEQ ID NO: 545 - DNA, 25 bp, Artificial Sequence
  Dyad patterns over-represented in STAR elements
  misc_feature (4)..(22): "N" stands for any nucleotide
ccgnnnnnnnnnnnnnnnnnnngag

SEQ ID NO: 546 - DNA, 16 bp, Artificial Sequence
  Dyad patterns over-represented in STAR elements
  misc_feature (4)..(13): "N" stands for any nucleotide
gggnnnnnnnnnngga

SEQ ID NO: 547 - DNA, 11 bp, Artificial Sequence
  Dyad patterns over-represented in STAR elements
  misc_feature (4)..(8): "N" stands for any nucleotide
cagnnnnnccg

SEQ ID NO: 548 - DNA, 9 bp, Artificial Sequence
  Dyad patterns over-represented in STAR elements
  misc_feature (4)..(6): "N" stands for any nucleotide
cgcnnnaga

SEQ ID NO: 549 - DNA, 6 bp, Artificial Sequence
  Dyad patterns over-represented in STAR elements
gccgcc

SEQ ID NO: 550 - DNA, 14 bp, Artificial Sequence
  Dyad patterns over-represented in STAR elements
  misc_feature (4)..(11): "N" stands for any nucleotide
cccnnnnnnnnggc

SEQ ID NO: 551 - DNA, 12 bp, Artificial Sequence
  Dyad patterns over-represented in STAR elements
  misc_feature (4)..(9): "N" stands for any nucleotide
cctnnnnnngcg

SEQ ID NO: 552 - DNA, 12 bp, Artificial Sequence
  Dyad patterns over-represented in STAR elements
  misc_feature (4)..(9): "N" stands for any nucleotide
gacnnnnnnccc

SEQ ID NO: 553 - DNA, 7 bp, Artificial Sequence
  Dyad patterns over-represented in STAR elements
  misc_feature (4)..(4): "N" stands for any nucleotide
cggnccc

SEQ ID NO: 554 - DNA, 21 bp, Artificial Sequence
  Dyad patterns over-represented in STAR elements
  misc_feature (4)..(18): "N" stands for any nucleotide
cccnnnnnnnnnnnnnnnccg

SEQ ID NO: 555 - DNA, 15 bp, Artificial Sequence
  Dyad patterns over-represented in STAR elements
  misc_feature (4)..(12): "N" stands for any nucleotide
cagnnnnnnnnnccc

SEQ ID NO: 556 - DNA, 16 bp, Artificial Sequence
  Dyad patterns over-represented in STAR elements
  misc_feature (4)..(13): "N" stands for any nucleotide
cggnnnnnnnnnnggc

SEQ ID NO: 557 - DNA, 16 bp, Artificial Sequence
  Dyad patterns over-represented in STAR elements
  misc_feature (4)..(13): "N" stands for any nucleotide
cgannnnnnnnnnacg

SEQ ID NO: 558 - DNA, 9 bp, Artificial Sequence
  Dyad patterns over-represented in STAR elements
  misc_feature (4)..(6): "N" stands for any nucleotide
gcgnnntcc

SEQ ID NO: 559 - DNA, 9 bp, Artificial Sequence
  Dyad patterns over-represented in STAR elements
  misc_feature (4)..(6): "N" stands for any nucleotide
cccnnngcc

SEQ ID NO: 560 - DNA, 7 bp, Artificial Sequence
  Dyad patterns over-represented in STAR elements
  misc_feature (4)..(4): "N" stands for any nucleotide
gcgnacc

SEQ ID NO: 561 - DNA, 15 bp, Artificial Sequence
  Dyad patterns over-represented in STAR elements
  misc_feature (4)..(12): "N" stands for any nucleotide
ccgnnnnnnnnnagg

SEQ ID NO: 562 - DNA, 22 bp, Artificial Sequence
  Dyad patterns over-represented in STAR elements
  misc_feature (4)..(19): "N" stands for any nucleotide
cgcnnnnnnnnnnnnnnnncag

SEQ ID NO: 563 - DNA, 6 bp, Artificial Sequence
  Dyad patterns over-represented in STAR elements
ggcccc

SEQ ID NO: 564 - DNA, 18 bp, Artificial Sequence
  Dyad patterns over-represented in STAR elements
  misc_feature (4)..(15): "N" stands for any nucleotide
aggnnnnnnnnnnnnccg

SEQ ID NO: 565 - DNA, 6 bp, Artificial Sequence
  Dyad patterns over-represented in STAR elements
ccggcg

SEQ ID NO: 566 - DNA, 8 bp, Artificial Sequence
  Dyad patterns over-represented in STAR elements
  misc_feature (4)..(5): "N" stands for any nucleotide
ccgnngcc

SEQ ID NO: 567 - DNA, 17 bp, Artificial Sequence
  Dyad patterns over-represented in STAR elements
  misc_feature (4)..(14): "N" stands for any nucleotide
ccgnnnnnnnnnnngtc

SEQ ID NO: 568 - DNA, 6 bp, Artificial Sequence
  Dyad patterns over-represented in STAR elements
cagccc

SEQ ID NO: 569 - DNA, 11 bp, Artificial Sequence
  Dyad patterns over-represented in STAR elements
  misc_feature (4)..(8): "N" stands for any nucleotide
cccnnnnnccg

SEQ ID NO: 570 - DNA, 26 bp, Artificial Sequence
  Dyad patterns over-represented in STAR elements
  misc_feature (4)..(23): "N" stands for any nucleotide
gccnnnnnnnnnnnnnnnnnnnnccc

SEQ ID NO: 571 - DNA, 8 bp, Artificial Sequence
  Dyad patterns over-represented in STAR elements
  misc_feature (4)..(5): "N" stands for any nucleotide
gacnncgc

SEQ ID NO: 572 - DNA, 12 bp, Artificial Sequence
  Dyad patterns over-represented in STAR elements
  misc_feature (4)..(9): "N" stands for any nucleotide
cgcnnnnnncac

SEQ ID NO: 573 - DNA, 20 bp, Artificial Sequence
  Dyad patterns over-represented in STAR elements
  misc_feature (4)..(17): "N" stands for any nucleotide
aggnnnnnnnnnnnnnngcg

SEQ ID NO: 574 - DNA, 11 bp, Artificial Sequence
  Dyad patterns over-represented in STAR elements
  misc_feature (4)..(8): "N" stands for any nucleotide
gacnnnnncgc

SEQ ID NO: 575 - DNA, 25 bp, Artificial Sequence
  Dyad patterns over-represented in STAR elements
  misc_feature (4)..(22): "N" stands for any nucleotide
cctnnnnnnnnnnnnnnnnnnnccg

SEQ ID NO: 576 - DNA, 18 bp, Artificial Sequence
  Dyad patterns over-represented in STAR elements
  misc_feature (4)..(15): "N" stands for any nucleotide
ccgnnnnnnnnnnnngga

SEQ ID NO: 577 - DNA, 15 bp, Artificial Sequence
  Dyad patterns over-represented in STAR elements
  misc_feature (4)..(12): "N" stands for any nucleotide
ggcnnnnnnnnngac

SEQ ID NO: 578 - DNA, 16 bp, Artificial Sequence
  Dyad patterns over-represented in STAR elements
  misc_feature (4)..(13): "N" stands for any nucleotide
aggnnnnnnnnnnggg

SEQ ID NO: 579 - DNA, 16 bp, Artificial Sequence
  Dyad patterns over-represented in STAR elements
  misc_feature (4)..(13): "N" stands for any nucleotide
ccgnnnnnnnnnngag

SEQ ID NO: 580 - DNA, 12 bp, Artificial Sequence
  Dyad patterns over-represented in STAR elements
  misc_feature (4)..(9): "N" stands for any nucleotide
cgcnnnnnngga

SEQ ID NO: 581 - DNA, 13 bp, Artificial Sequence
  Dyad patterns over-represented in STAR elements
  misc_feature (4)..(10): "N" stands for any nucleotide
cgcnnnnnnnagc

SEQ ID NO: 582 - DNA, 19 bp, Artificial Sequence
  Dyad patterns over-represented in STAR elements
  misc_feature (4)..(16): "N" stands for any nucleotide
ccannnnnnnnnnnnncgg

SEQ ID NO: 583 - DNA, 12 bp, Artificial Sequence
  Dyad patterns over-represented in STAR elements
  misc_feature (4)..(9): "N" stands for any nucleotide
cggnnnnnngga

SEQ ID NO: 584 - DNA, 25 bp, Artificial Sequence
  Dyad patterns over-represented in STAR elements
  misc_feature (4)..(22): "N" stands for any nucleotide
cgcnnnnnnnnnnnnnnnnnnngcc

SEQ ID NO: 585 - DNA, 18 bp, Artificial Sequence
  Dyad patterns over-represented in STAR elements
  misc_feature (4)..(15): "N" stands for any nucleotide
ccannnnnnnnnnnncgc

SEQ ID NO: 586 - DNA, 7 bp, Artificial Sequence
  Dyad patterns over-represented in STAR elements
  misc_feature (4)..(4): "N" stands for any nucleotide
cggnggc

SEQ ID NO: 587 - DNA, 9 bp, Artificial Sequence
  Dyad patterns over-represented in STAR elements
  misc_feature (4)..(6): "N" stands for any nucleotide
gcgnnncca

SEQ ID NO: 588 - DNA, 7 bp, Artificial Sequence
  Dyad patterns over-represented in STAR elements
  misc_feature (4)..(4): "N" stands for any nucleotide
aggncgc

SEQ ID NO: 589 - DNA, 11 bp, Artificial Sequence
  Dyad patterns over-represented in STAR elements
  misc_feature (4)..(8): "N" stands for any nucleotide
ctcnnnnncgc

SEQ ID NO: 590 - DNA, 6 bp, Artificial Sequence
  Dyad patterns over-represented in STAR elements
cccacg

SEQ ID NO: 591 - DNA, 23 bp, Artificial Sequence
  Dyad patterns over-represented in STAR elements
  misc_feature (4)..(20): "N" stands for any nucleotide
cagnnnnnnnnnnnnnnnnnccg

SEQ ID NO: 592 - DNA, 10 bp, Artificial Sequence
  Dyad patterns over-represented in STAR elements
  misc_feature (4)..(7): "N" stands for any nucleotide
ggcnnnnccc

SEQ ID NO: 593 - DNA, 14 bp, Artificial Sequence
  Dyad patterns over-represented in STAR elements
  misc_feature (4)..(11): "N" stands for any nucleotide
aggnnnnnnnngcg

SEQ ID NO: 594 - DNA, 7 bp, Artificial Sequence
  Dyad patterns over-represented in STAR elements
  misc_feature (4)..(4): "N" stands for any nucleotide
ctgnccc

SEQ ID NO: 595 - DNA, 22 bp, Artificial Sequence
  Dyad patterns over-represented in STAR elements
  misc_feature (4)..(19): "N" stands for any nucleotide
cccnnnnnnnnnnnnnnnncag

SEQ ID NO: 596 - DNA, 15 bp, Artificial Sequence
  Dyad patterns over-represented in STAR elements
  misc_feature (4)..(12): "N" stands for any nucleotide
cgcnnnnnnnnngac

SEQ ID NO: 597 - DNA, 12 bp, Artificial Sequence
  Dyad patterns over-represented in STAR elements
  misc_feature (4)..(9): "N" stands for any nucleotide
cagnnnnnnccg

SEQ ID NO: 598 - DNA, 18 bp, Artificial Sequence
  Dyad patterns over-represented in STAR elements
  misc_feature (4)..(15): "N" stands for any nucleotide
cgtnnnnnnnnnnnncgc

SEQ ID NO: 599 - DNA, 13 bp, Artificial Sequence
  Dyad patterns over-represented in STAR elements
  misc_feature (4)..(10): "N" stands for any nucleotide
ctcnnnnnnngcc

SEQ ID NO: 600 - DNA, 25 bp, Artificial Sequence
  Dyad patterns over-represented in STAR elements
  misc_feature (4)..(22): "N" stands for any nucleotide
cgcnnnnnnnnnnnnnnnnnnntcc

SEQ ID NO: 601 - DNA, 13 bp, Artificial Sequence
  Dyad patterns over-represented in STAR elements
  misc_feature (4)..(10): "N" stands for any nucleotide
cccnnnnnnngcc

SEQ ID NO: 602 - DNA, 19 bp, Artificial Sequence
  Dyad patterns over-represented in STAR elements
  misc_feature (4)..(16): "N" stands for any nucleotide
cagnnnnnnnnnnnnncgg

SEQ ID NO: 603 - DNA, 7 bp, Artificial Sequence
  Dyad patterns over-represented in STAR elements
  misc_feature (4)..(4): "N" stands for any nucleotide
cgcngcc

SEQ ID NO: 604 - DNA, 23 bp, Artificial Sequence
  Dyad patterns over-represented in STAR elements
  misc_feature (4)..(20): "N" stands for any nucleotide
cgcnnnnnnnnnnnnnnnnnccg

SEQ ID NO: 605 - DNA, 10 bp, Artificial Sequence
  Dyad patterns over-represented in STAR elements
  misc_feature (4)..(7): "N" stands for any nucleotide
aggnnnnccc

SEQ ID NO: 606 - DNA, 16 bp, Artificial Sequence
  Dyad patterns over-represented in STAR elements
  misc_feature (4)..(13): "N" stands for any nucleotide
agcnnnnnnnnnncgc

SEQ ID NO: 607 - DNA, 17 bp, Artificial Sequence
  Dyad patterns over-represented in STAR elements
  misc_feature (4)..(14): "N" stands for any nucleotide
cccnnnnnnnnnnncgg

SEQ ID NO: 608 - DNA, 14 bp, Artificial Sequence
  Dyad patterns over-represented in STAR elements
  misc_feature (4)..(11): "N" stands for any nucleotide
cccnnnnnnnngcc

SEQ ID NO: 609 - DNA, 7 bp, Artificial Sequence
  Dyad patterns over-represented in STAR elements
  misc_feature (4)..(4): "N" stands for any nucleotide
ccgncgg

SEQ ID NO: 610 - DNA, 7 bp, Artificial Sequence
  Dyad patterns over-represented in STAR elements
  misc_feature (4)..(4): "N" stands for any nucleotide
cccnacc

SEQ ID NO: 611 - DNA, 6 bp, Artificial Sequence
  Dyad patterns over-represented in STAR elements
cgccag

SEQ ID NO: 612 - DNA, 25 bp, Artificial Sequence
  Dyad patterns over-represented in STAR elements
  misc_feature (4)..(22): "N" stands for any nucleotide
ccgnnnnnnnnnnnnnnnnnnntgc

SEQ ID NO: 613 - DNA, 10 bp, Artificial Sequence
  Dyad patterns over-represented in STAR elements
  misc_feature (4)..(7): "N" stands for any nucleotide
gcgnnnncga

SEQ ID NO: 614 - DNA, 25 bp, Artificial Sequence
  Dyad patterns over-represented in STAR elements
  misc_feature (4)..(22): "N" stands for any nucleotide
ccgnnnnnnnnnnnnnnnnnnngcc

SEQ ID NO: 615 - DNA, 16 bp, Artificial Sequence
  Dyad patterns over-represented in STAR elements
  misc_feature (4)..(13): "N" stands for any nucleotide
ccannnnnnnnnnccc

SEQ ID NO: 616 - DNA, 19 bp, Artificial Sequence
  Dyad patterns over-represented in STAR elements
  misc_feature (4)..(16): "N" stands for any nucleotide
cagnnnnnnnnnnnnnggg

SEQ ID NO: 617 - DNA, 24 bp, Artificial Sequence
  Dyad patterns over-represented in STAR elements
  misc_feature (4)..(21): "N" stands for any nucleotide
agcnnnnnnnnnnnnnnnnnncgg

SEQ ID NO: 618 - DNA, 14 bp, Artificial Sequence
  Dyad patterns over-represented in STAR elements
  misc_feature (4)..(11): "N" stands for any nucleotide
cgannnnnnnncgc

SEQ ID NO: 619 - DNA, 10 bp, Artificial Sequence
  Dyad patterns over-represented in STAR elements
  misc_feature (4)..(7): "N" stands for any nucleotide
agcnnnnccc

SEQ ID NO: 620 - DNA, 12 bp, Artificial Sequence
  Dyad patterns over-represented in STAR elements
  misc_feature (4)..(9): "N" stands for any nucleotide
ggannnnnnccc

SEQ ID NO: 621 - DNA, 19 bp, Artificial Sequence
  Dyad patterns over-represented in STAR elements
  misc_feature (4)..(16): "N" stands for any nucleotide
cggnnnnnnnnnnnnnaag

SEQ ID NO: 622 - DNA, 17 bp, Artificial Sequence
  Dyad patterns over-represented in STAR elements
  misc_feature (4)..(14): "N" stands for any nucleotide
accnnnnnnnnnnncgc

SEQ ID NO: 623 - DNA, 18 bp, Artificial Sequence
  Dyad patterns over-represented in STAR elements
  misc_feature (4)..(15): "N" stands for any nucleotide
ccgnnnnnnnnnnnncag

SEQ ID NO: 624 - DNA, 18 bp, Artificial Sequence
  Dyad patterns over-represented in STAR elements
  misc_feature (4)..(15): "N" stands for any nucleotide
cccnnnnnnnnnnnnggg

SEQ ID NO: 625 - DNA, 23 bp, Artificial Sequence
  Dyad patterns over-represented in STAR elements
  misc_feature (4)..(20): "N" stands for any nucleotide
cacnnnnnnnnnnnnnnnnnacg

SEQ ID NO: 626 - DNA, 24 bp, Artificial Sequence
  Dyad patterns over-represented in STAR elements
  misc_feature (4)..(21): "N" stands for any nucleotide
cagnnnnnnnnnnnnnnnnnnccc

SEQ ID NO: 627 - DNA, 16 bp, Artificial Sequence
  Dyad patterns over-represented in STAR elements
  misc_feature (4)..(13): "N" stands for any nucleotide
cgtnnnnnnnnnngtc

SEQ ID NO: 628 - DNA, 19 bp, Artificial Sequence
  Dyad patterns over-represented in STAR elements
  misc_feature (4)..(16): "N" stands for any nucleotide
cccnnnnnnnnnnnnngcg

SEQ ID NO: 629 - DNA, 7 bp, Artificial Sequence
  Dyad patterns over-represented in STAR elements
  misc_feature (4)..(4): "N" stands for any nucleotide
gcancgc

SEQ ID NO: 630 - DNA, 10 bp, Artificial Sequence
  Dyad patterns over-represented in STAR elements
  misc_feature (4)..(7): "N" stands for any nucleotide
agannnnccg

SEQ ID NO: 631 - DNA, 16 bp, Artificial Sequence
  Dyad patterns over-represented in STAR elements
  misc_feature (4)..(13): "N" stands for any nucleotide
gcgnnnnnnnnnnagc

SEQ ID NO: 632 - DNA, 6 bp, Artificial Sequence
  Dyad patterns over-represented in STAR elements
cgcgga

SEQ ID NO: 633 - DNA, 10 bp, Artificial Sequence
  Dyad patterns over-represented in STAR elements
  misc_feature (4)..(7): "N" stands for any nucleotide
cggnnnngac

SEQ ID NO: 634 - DNA, 18 bp, Artificial Sequence
  Dyad patterns over-represented in STAR elements
  misc_feature (4)..(15): "N" stands for any nucleotide
cccnnnnnnnnnnnncgc

SEQ ID NO: 635 - DNA, 21 bp, Artificial Sequence
  Dyad patterns over-represented in STAR elements
  misc_feature (4)..(18): "N" stands for any nucleotide
gccnnnnnnnnnnnnnnnccc

SEQ ID NO: 636 - DNA, 12 bp, Artificial Sequence
  Dyad patterns over-represented in STAR elements
  misc_feature (4)..(9): "N" stands for any nucleotide
gcgnnnnnntcc

SEQ ID NO: 637 - DNA, 9 bp, Artificial Sequence
  Dyad patterns over-represented in STAR elements
  misc_feature (4)..(6): "N" stands for any nucleotide
cggnnncag

SEQ ID NO: 638 - DNA, 9 bp, Artificial Sequence
  Dyad patterns over-represented in STAR elements
  misc_feature (4)..(6): "N" stands for any nucleotide
cccnnncca

SEQ ID NO: 639 - DNA, 9 bp, Artificial Sequence
  Dyad patterns over-represented in STAR elements
  misc_feature (4)..(6): "N" stands for any nucleotide
agcnnnccc

SEQ ID NO: 640 - DNA, 22 bp, Artificial Sequence
  Dyad patterns over-represented in STAR elements
  misc_feature (4)..(19): "N" stands for any nucleotide
gggnnnnnnnnnnnnnnnngca

SEQ ID NO: 641 - DNA, 14 bp, Artificial Sequence
  Dyad patterns over-represented in STAR elements
  misc_feature (4)..(11): "N" stands for any nucleotide
aggnnnnnnnnccg

SEQ ID NO: 642 - DNA, 6 bp, Artificial Sequence
  Dyad patterns over-represented in STAR elements
cccccg

SEQ ID NO: 643 - DNA, 11 bp, Artificial Sequence
  Dyad patterns over-represented in STAR elements
  misc_feature (4)..(8): "N" stands for any nucleotide
gcgnnnnngac

SEQ ID NO: 644 - DNA, 15 bp, Artificial Sequence
  Dyad patterns over-represented in STAR elements
  misc_feature (4)..(12): "N" stands for any nucleotide
cccnnnnnnnnnacc

SEQ ID NO: 645 - DNA, 11 bp, Artificial Sequence
  Dyad patterns over-represented in STAR elements
  misc_feature (4)..(8): "N" stands for any nucleotide
ctgnnnnncgc

SEQ ID NO: 646 - DNA, 20 bp, Artificial Sequence
  Dyad patterns over-represented in STAR elements
  misc_feature (4)..(17): "N" stands for any nucleotide
cgcnnnnnnnnnnnnnnctc

SEQ ID NO: 647 - DNA, 20 bp, Artificial Sequence
  Dyad patterns over-represented in STAR elements
  misc_feature (4)..(17): "N" stands for any nucleotide
cggnnnnnnnnnnnnnngca

SEQ ID NO: 648 - DNA, 14 bp, Artificial Sequence
  Dyad patterns over-represented in STAR elements
  misc_feature (4)..(11): "N" stands for any nucleotide
ccgnnnnnnnngcc

SEQ ID NO: 649 - DNA, 13 bp, Artificial Sequence
  Dyad patterns over-represented in STAR elements
  misc_feature (4)..(10): "N" stands for any nucleotide
ccgnnnnnnncac

SEQ ID NO: 650 - DNA, 14 bp, Artificial Sequence
  Dyad patterns over-represented in STAR elements
  misc_feature (4)..(11): "N" stands for any nucleotide
agcnnnnnnnngcg

SEQ ID NO: 651 - DNA, 22 bp, Artificial Sequence
  Dyad patterns over-represented in STAR elements
  misc_feature (4)..(19): "N" stands for any nucleotide
cggnnnnnnnnnnnnnnnngga

SEQ ID NO: 652 - DNA, 18 bp, Artificial Sequence
  Dyad patterns over-represented in STAR elements
  misc_feature (4)..(15): "N" stands for any nucleotide
ccannnnnnnnnnnnccg

SEQ ID NO: 653 - DNA, 8 bp, Artificial Sequence
  Dyad patterns over-represented in STAR elements
  misc_feature (4)..(5): "N" stands for any nucleotide
cggnnccc

SEQ ID NO: 654 - DNA, 19 bp, Artificial Sequence
  Dyad patterns over-represented in STAR elements
  misc_feature (4)..(16): "N" stands for any nucleotide
ccannnnnnnnnnnnnggg

SEQ ID NO: 655 - DNA, 21 bp, Artificial Sequence
  Dyad patterns over-represented in STAR elements
  misc_feature (4)..(18): "N" stands for any nucleotide
cggnnnnnnnnnnnnnnngca

SEQ ID NO: 656 - DNA, 15 bp, Artificial Sequence
  Dyad patterns over-represented in STAR elements
  misc_feature (4)..(12): "N" stands for any nucleotide
cgcnnnnnnnnngca

SEQ ID NO: 657 - DNA, 25 bp, Artificial Sequence
  Dyad patterns over-represented in STAR elements
  misc_feature (4)..(22): "N" stands for any nucleotide
cggnnnnnnnnnnnnnnnnnnncca

SEQ ID NO: 658 - DNA, 21 bp, Artificial Sequence
  Dyad patterns over-represented in STAR elements
  misc_feature (4)..(18): "N" stands for any nucleotide
gggnnnnnnnnnnnnnnncga

SEQ ID NO: 659 - DNA, 16 bp, Artificial Sequence
  Dyad patterns over-represented in STAR elements
  misc_feature (4)..(13): "N" stands for any nucleotide
cccnnnnnnnnnncgc

SEQ ID NO: 660 - DNA, 20 bp, Artificial Sequence
  Dyad patterns over-represented in STAR elements
  misc_feature (4)..(17): "N" stands for any nucleotide
ctcnnnnnnnnnnnnnncgc

SEQ ID NO: 661 - DNA, 17 bp, Artificial Sequence
  Dyad patterns over-represented in STAR elements
  misc_feature (4)..(14): "N" stands for any nucleotide
cacnnnnnnnnnnngcg

SEQ ID NO: 662 - DNA, 8 bp, Artificial Sequence
  Dyad patterns over-represented in STAR elements
  misc_feature (4)..(5): "N" stands for any nucleotide
ccgnnggc

SEQ ID NO: 663 - DNA, 24 bp, Artificial Sequence
  Dyad patterns over-represented in STAR elements
  misc_feature (4)..(21): "N" stands for any nucleotide
ctgnnnnnnnnnnnnnnnnnnccc

SEQ ID NO: 664 - DNA, 19 bp, Artificial Sequence
  Dyad patterns over-represented in STAR elements
  misc_feature (4)..(16): "N" stands for any nucleotide
gggnnnnnnnnnnnnncac

SEQ ID NO: 665 - DNA, 21 bp, Artificial Sequence
  Dyad patterns over-represented in STAR elements
  misc_feature (4)..(18): "N" stands for any nucleotide
cctnnnnnnnnnnnnnnnggc

SEQ ID NO: 666 - DNA, 26 bp, Artificial Sequence
  Dyad patterns over-represented in STAR elements
  misc_feature (4)..(23): "N" stands for any nucleotide
cccnnnnnnnnnnnnnnnnnnnncga

SEQ ID NO: 667 - DNA, 14 bp, Artificial Sequence
  Dyad patterns over-represented in STAR elements
  misc_feature (4)..(11): "N" stands for any nucleotide
cccnnnnnnnncga

SEQ ID NO: 668 - DNA, 13 bp, Artificial Sequence
  Dyad patterns over-represented in STAR elements
  misc_feature (4)..(10): "N" stands for any nucleotide
gagnnnnnnnccc

SEQ ID NO: 669 - DNA, 8 bp, Artificial Sequence
  Dyad patterns over-represented in STAR elements
  misc_feature (4)..(5): "N" stands for any nucleotide
cgcnnccg

SEQ ID NO: 670 - DNA, 6 bp, Artificial Sequence
  Dyad patterns over-represented in STAR elements
ccctcc

SEQ ID NO: 671 - DNA, 6 bp, Artificial Sequence
  Dyad patterns over-represented in STAR elements
agcgcc

SEQ ID NO: 672 - DNA, 8 bp, Artificial Sequence
  Dyad patterns over-represented in STAR elements
  misc_feature (4)..(5): "N" stands for any nucleotide
cccnntcc

SEQ ID NO: 673 - DNA, 11 bp, Artificial Sequence
  Dyad patterns over-represented in STAR elements
  misc_feature (4)..(8): "N" stands for any nucleotide
ccgnnnnnccc

SEQ ID NO: 674 - DNA, 19 bp, Artificial Sequence
  Dyad patterns over-represented in STAR elements
  misc_feature (4)..(16): "N" stands for any nucleotide
cgcnnnnnnnnnnnnncgc

SEQ ID NO: 675 - DNA, 7 bp, Artificial Sequence
  Dyad patterns over-represented in STAR elements
  misc_feature (4)..(4): "N" stands for any nucleotide
cccncgc

SEQ ID NO: 676 - DNA, 22 bp, Artificial Sequence
  Dyad patterns over-represented in STAR elements
  misc_feature (4)..(19): "N" stands for any nucleotide
gccnnnnnnnnnnnnnnnngca

SEQ ID NO: 677 - DNA, 22 bp, Artificial Sequence
  Dyad patterns over-represented in STAR elements
  misc_feature (4)..(19): "N" stands for any nucleotide
cccnnnnnnnnnnnnnnnncca

SEQ ID NO: 678 - DNA, 19 bp, Artificial Sequence
  Dyad patterns over-represented in STAR elements
  misc_feature (4)..(16): "N" stands for any nucleotide
ccgnnnnnnnnnnnnncgc

SEQ ID NO: 679 - DNA, 23 bp, Artificial Sequence
  Dyad patterns over-represented in STAR elements
  misc_feature (4)..(20): "N" stands for any nucleotide
ccgnnnnnnnnnnnnnnnnncag

SEQ ID NO: 680 - DNA, 24 bp, Artificial Sequence
  Dyad patterns over-represented in STAR elements
  misc_feature (4)..(21): "N" stands for any nucleotide
cggnnnnnnnnnnnnnnnnnnggc

SEQ ID NO: 681 - DNA, 20 bp, Artificial Sequence
  Dyad patterns over-represented in STAR elements
  misc_feature (4)..(17): "N" stands for any nucleotide
ccgnnnnnnnnnnnnnnagg

SEQ ID NO: 682 - DNA, 11 bp, Artificial Sequence
  Dyad patterns over-represented in STAR elements
  misc_feature (4)..(8): "N" stands for any nucleotide
cccnnnnncgg

SEQ ID NO: 683 - DNA, 12 bp, Artificial Sequence
  Dyad patterns over-represented in STAR elements
  misc_feature (4)..(9): "N" stands for any nucleotide
cccnnnnnngga

SEQ ID NO: 684 - DNA, 8 bp, Artificial Sequence
  Dyad patterns over-represented in STAR elements
  misc_feature (4)..(5): "N" stands for any nucleotide
acgnnccc

SEQ ID NO: 685 - DNA, 15 bp, Artificial Sequence
  Dyad patterns over-represented in STAR elements
  misc_feature (4)..(12): "N" stands for any nucleotide
ccannnnnnnnnccg

SEQ ID NO: 686 - DNA, 25 bp, Artificial Sequence
  Dyad patterns over-represented in STAR elements
  misc_feature (4)..(22): "N" stands for any nucleotide
cccnnnnnnnnnnnnnnnnnnncca

SEQ ID NO: 687 - DNA, 6 bp, Artificial Sequence
  Dyad patterns over-represented in STAR elements
cagggg

SEQ ID NO: 688 - DNA, 7 bp, Artificial Sequence
  Dyad patterns over-represented in STAR elements
  misc_feature (4)..(4): "N" stands for any nucleotide
agcnccc

SEQ ID NO: 689 - DNA, 13 bp, Artificial Sequence
  Dyad patterns over-represented in STAR elements
  misc_feature (4)..(10): "N" stands for any nucleotide
gcgnnnnnnntcc

SEQ ID NO: 690 - DNA, 24 bp, Artificial Sequence
  Dyad patterns over-represented in STAR elements
  misc_feature (4)..(21): "N" stands for any nucleotide
acgnnnnnnnnnnnnnnnnnncca

SEQ ID NO: 691 - DNA, 20 bp, Artificial Sequence
  Dyad patterns over-represented in STAR elements
  misc_feature (4)..(17): "N" stands for any nucleotide
gctnnnnnnnnnnnnnnccc

SEQ ID NO: 692 - DNA, 20 bp, Artificial Sequence
  Dyad patterns over-represented in STAR elements
  misc_feature (4)..(17): "N" stands for any nucleotide
gcgnnnnnnnnnnnnnnccc

SEQ ID NO: 693 - DNA, 25 bp, Artificial Sequence
  Dyad patterns over-represented in STAR elements
  misc_feature (4)..(22): "N" stands for any nucleotide
gcgnnnnnnnnnnnnnnnnnnnagc

SEQ ID NO: 694 - DNA, 14 bp, Artificial Sequence
  Dyad patterns over-represented in STAR elements
  misc_feature (4)..(11): "N" stands for any nucleotide
ccgnnnnnnnncag

SEQ ID NO: 695 - DNA, 12 bp, Artificial Sequence
  Dyad patterns over-represented in STAR elements
  misc_feature (4)..(9): "N" stands for any nucleotide
gcgnnnnnngcc

SEQ ID NO: 696 - DNA, 16 bp, Artificial Sequence
  Dyad patterns over-represented in STAR elements
  misc_feature (4)..(13): "N" stands for any nucleotide
gcgnnnnnnnnnngca

SEQ ID NO: 697 - DNA, 13 bp, Artificial Sequence
  Dyad patterns over-represented in STAR elements
  misc_feature (4)..(10): "N" stands for any nucleotide
cctnnnnnnngcc

SEQ ID NO: 698 - DNA, 19 bp, Artificial Sequence
  Dyad patterns over-represented in STAR elements
  misc_feature (4)..(16): "N" stands for any nucleotide
gccnnnnnnnnnnnnngcc

SEQ ID NO: 699 - DNA, 20 bp, Artificial Sequence
  Dyad patterns over-represented in STAR elements
  misc_feature (4)..(17): "N" stands for any nucleotide
cccnnnnnnnnnnnnnngcc

SEQ ID NO: 700 - DNA, 21 bp, Artificial Sequence
  Dyad patterns over-represented in STAR elements
  misc_feature (4)..(18): "N" stands for any nucleotide
cccnnnnnnnnnnnnnnncgg

SEQ ID NO: 701 - DNA, 19 bp, Artificial Sequence
  Dyad patterns over-represented in STAR elements
  misc_feature (4)..(16): "N" stands for any nucleotide
ccannnnnnnnnnnnncgc

SEQ ID NO: 702 - DNA, 17 bp, Artificial Sequence
  Dyad patterns over-represented in STAR elements
  misc_feature (4)..(14): "N" stands for any nucleotide
agcnnnnnnnnnnnggg

SEQ ID NO: 703 - DNA, 6 bp, Artificial Sequence
  Dyad patterns over-represented in STAR elements
ggagcc

SEQ ID NO: 704 - DNA, 9 bp, Artificial Sequence
  Dyad patterns over-represented in STAR elements
  misc_feature (4)..(6): "N" stands for any nucleotide
gccnnntcc

SEQ ID NO: 705 - DNA, 11 bp, Artificial Sequence
  Dyad patterns over-represented in STAR elements
  misc_feature (4)..(8): "N" stands for any nucleotide
cctnnnnngcc

SEQ ID NO: 706 - DNA, 24 bp, Artificial Sequence
  Dyad patterns over-represented in STAR elements
  misc_feature (4)..(21): "N" stands for any nucleotide
cggnnnnnnnnnnnnnnnnnnccc

SEQ ID NO: 707 - DNA, 9 bp, Artificial Sequence
  Dyad patterns over-represented in STAR elements
  misc_feature (4)..(6): "N" stands for any nucleotide
cctnnnggc

SEQ ID NO: 708 - DNA, 6 bp, Artificial Sequence
  Dyad patterns over-represented in STAR elements
ccgctc

SEQ ID NO: 709 - DNA, 23 bp, Artificial Sequence
  Dyad patterns over-represented in STAR elements
  misc_feature (1)..(20): "N" stands for any nucleotide
agcnnnnnnnnnnnnnnnnngcg

SEQ ID NO: 710 - DNA, 20 bp, Artificial Sequence
  Dyad patterns over-represented in STAR elements
  misc_feature (4)..(17): "N" stands for any nucleotide
acgnnnnnnnnnnnnnnggg

SEQ ID NO: 711 - DNA, 18 bp, Artificial Sequence
  Dyad patterns over-represented in STAR elements
  misc_feature (4)..(15): "N" stands for any nucleotide
cgannnnnnnnnnnnggc

SEQ ID NO: 712 - DNA, 26 bp, Artificial Sequence
  Dyad patterns over-represented in STAR elements
  misc_feature (4)..(23): "N" stands for any nucleotide
cccnnnnnnnnnnnnnnnnnnnncgc

SEQ ID NO: 713 - DNA, 18 bp, Artificial Sequence
  Dyad patterns over-represented in STAR elements
  misc_feature (4)..(15): "N" stands for any nucleotide
acgnnnnnnnnnnnnctg

SEQ ID NO: 714 - DNA, 6 bp, Artificial Sequence
  Dyad patterns over-represented in STAR elements
ccgccc

SEQ ID NO: 715 - DNA, 16 bp, Artificial Sequence
  Dyad patterns over-represented in STAR elements
  misc_feature (4)..(13): "N" stands for any nucleotide
ccgnnnnnnnnnngga

SEQ ID NO: 716 - DNA, 9 bp, Artificial Sequence
  Dyad patterns over-represented in STAR elements
  misc_feature (4)..(6): "N" stands for any nucleotide
cccnnngcg

SEQ ID NO: 717 - DNA, 20 bp, Artificial Sequence
  Dyad patterns over-represented in STAR elements
  misc_feature (4)..(17): "N" stands for any nucleotide
gcgnnnnnnnnnnnnnncgc

SEQ ID NO: 718 - DNA, 14 bp, Artificial Sequence
  Dyad patterns over-represented in STAR elements
  misc_feature (4)..(11): "N" stands for any nucleotide
ccgnnnnnnnncgc

SEQ ID NO: 719 - DNA, 16 bp, Artificial Sequence
  Dyad patterns over-represented in STAR elements
  misc_feature (4)..(13): "N" stands for any nucleotide
cgcnnnnnnnnnnaca

SEQ ID NO: 720 - DNA, 25 bp, Artificial Sequence
  Dyad patterns over-represented in STAR elements
  misc_feature (4)..(22): "N" stands for any nucleotide
cccnnnnnnnnnnnnnnnnnnnccg

SEQ ID NO: 721 - DNA, 20 bp, Artificial Sequence
  Dyad patterns over-represented in STAR elements
  misc_feature (4)..(17): "N" stands for any nucleotide
cacnnnnnnnnnnnnnncgc

SEQ ID NO: 722 - DNA, 9 bp, Artificial Sequence
  Dyad patterns over-represented in STAR elements
  misc_feature (4)..(6): "N" stands for any nucleotide
gacnnnggc

SEQ ID NO: 723 - DNA, 13 bp, Artificial Sequence
  Dyad patterns over-represented in STAR elements
  misc_feature (4)..(10): "N" stands for any nucleotide
gaannnnnnncgc

SEQ ID NO: 724 - DNA, 22 bp, Artificial Sequence
  Dyad patterns over-represented in STAR elements
  misc_feature (4)..(19): "N" stands for any nucleotide
cgcnnnnnnnnnnnnnnnnggc

SEQ ID NO: 725 - DNA, 15 bp, Artificial Sequence
  Dyad patterns over-represented in STAR elements
  misc_feature (4)..(12): "N" stands for any nucleotide
ggcnnnnnnnnnccc

SEQ ID NO: 726 - DNA, 15 bp, Artificial Sequence
  Dyad patterns over-represented in STAR elements
  misc_feature (4)..(12): "N" stands for any nucleotide
cccnnnnnnnnngcc

SEQ ID NO: 727 - DNA, 6 bp, Artificial Sequence
  Dyad patterns over-represented in STAR elements
cgctgc

SEQ ID NO: 728 - DNA, 14 bp, Artificial Sequence
  Dyad patterns over-represented in STAR elements
  misc_feature (4)..(11): "N" stands for any nucleotide
cctnnnnnnnnggc

SEQ ID NO: 729 - DNA, 14 bp, Artificial Sequence
  Dyad patterns over-represented in STAR elements
  misc_feature (4)..(11): "N" stands for any nucleotide
ccannnnnnnnccc

SEQ ID NO: 730 - DNA, 8 bp, Artificial Sequence
  Dyad patterns over-represented in STAR elements
  misc_feature (4)..(5): "N" stands for any nucleotide
gacnnccc

SEQ ID NO: 731 - DNA, 7 bp, Artificial Sequence
  Dyad patterns over-represented in STAR elements
  misc_feature (4)..(4): "N" stands for any nucleotide
ggcnccc

SEQ ID NO: 732 - DNA, 6 bp, Artificial Sequence
  Dyad patterns over-represented in STAR elements
cgcagc

SEQ ID NO: 733 - DNA, 10 bp, Artificial Sequence
  Dyad patterns over-represented in STAR elements
  misc_feature (4)..(7): "N" stands for any nucleotide
aggnnnngcg

SEQ ID NO: 734 - DNA, 12 bp, Artificial Sequence
  Dyad patterns over-represented in STAR elements
  misc_feature (4)..(9): "N" stands for any nucleotide
cggnnnnnntcc

SEQ ID NO: 735 - DNA, 25 bp, Artificial Sequence
  Dyad patterns over-represented in STAR elements
  misc_feature (4)..(22): "N" stands for any nucleotide
acgnnnnnnnnnnnnnnnnnnnggc

SEQ ID NO: 736 - DNA, 14 bp, Artificial Sequence
  Dyad patterns over-represented in STAR elements
  misc_feature (4)..(11): "N" stands for any nucleotide
cccnnnnnnnnacg

SEQ ID NO: 737 - DNA, 24 bp, Artificial Sequence
  Dyad patterns over-represented in STAR elements
  misc_feature (4)..(21): "N" stands for any nucleotide
cccnnnnnnnnnnnnnnnnnngcc

SEQ ID NO: 738 - DNA, 8 bp, Artificial Sequence
  Dyad patterns over-represented in STAR elements
  misc_feature (4)..(5): "N" stands for any nucleotide
gccnncga

SEQ ID NO: 739 - DNA, 14 bp, Artificial Sequence
  Dyad patterns over-represented in STAR elements
  misc_feature (4)..(11): "N" stands for any nucleotide
cccnnnnnnnngcg

SEQ ID NO: 740 - DNA, 6 bp, Artificial Sequence
  Dyad patterns over-represented in STAR elements
cccctc

SEQ ID NO: 741 - DNA, 17 bp, Artificial Sequence
  Dyad patterns over-represented in STAR elements
  misc_feature (4)..(14): "N" stands for any nucleotide
gccnnnnnnnnnnncgc

SEQ ID NO: 742 - DNA, 15 bp, Artificial Sequence
  Dyad patterns over-represented in STAR elements
  misc_feature (4)..(12): "N" stands for any nucleotide
agcnnnnnnnnnccc

SEQ ID NO: 743 - DNA, 6 bp, Artificial Sequence
  Dyad patterns over-represented in STAR elements
gctgcc

SEQ ID NO: 744 - DNA, 9 bp, Artificial Sequence
  Dyad patterns over-represented in STAR elements
  misc_feature (4)..(6): "N" stands for any nucleotide
cgcnnnccc

SEQ ID NO: 745 - DNA, 8 bp, Artificial Sequence
  Dyad patterns over-represented in STAR elements
  misc_feature (4)..(5): "N" stands for any nucleotide
cccnnccc

SEQ ID NO: 746 - DNA, 15 bp, Artificial Sequence
  Dyad patterns over-represented in STAR elements
  misc_feature (4)..(12): "N" stands for any nucleotide
gccnnnnnnnnncgc

SEQ ID NO: 747 - DNA, 25 bp, Artificial Sequence
  Dyad patterns over-represented in STAR elements
  misc_feature (4)..(22): "N" stands for any nucleotide
gcannnnnnnnnnnnnnnnnnncgc

SEQ ID NO: 748 - DNA, 10 bp, Artificial Sequence
  Dyad patterns over-represented in STAR elements
  misc_feature (4)..(7): "N" stands for any nucleotide
cagnnnncgg

SEQ ID NO: 749 - DNA, 8 bp, Artificial Sequence
  Dyad patterns over-represented in STAR elements
  misc_feature (4)..(5): "N" stands for any nucleotide
cagnnggg

SEQ ID NO: 750 - DNA, 22 bp, Artificial Sequence
  Dyad patterns over-represented in STAR elements
  misc_feature (4)..(19): "N" stands for any nucleotide
gccnnnnnnnnnnnnnnnnccc

SEQ ID NO: 751 - DNA, 11 bp, Artificial Sequence
  Dyad patterns over-represented in STAR elements
  misc_feature (4)..(8): "N" stands for any nucleotide
gagnnnnnccc

SEQ ID NO: 752 - DNA, 22 bp, Artificial Sequence
  Dyad patterns over-represented in STAR elements
  misc_feature (4)..(19): "N" stands for any nucleotide
cctnnnnnnnnnnnnnnnntcg

SEQ ID NO: 753 - DNA, 9 bp, Artificial Sequence
  Dyad patterns over-represented in STAR elements
  misc_feature (4)..(6): "N" stands for any nucleotide
cccnnnggc

SEQ ID NO: 754 - DNA, 19 bp, Artificial Sequence
  Dyad patterns over-represented in STAR elements
  misc_feature (4)..(16): "N" stands for any nucleotide
gcgnnnnnnnnnnnnngga

SEQ ID NO: 755 - DNA, 23 bp, Artificial Sequence
  Dyad patterns over-represented in STAR elements
  misc_feature (4)..(20): "N" stands for any nucleotide
gccnnnnnnnnnnnnnnnnnggc

SEQ ID NO: 756 - DNA, 20 bp, Artificial Sequence
  Dyad patterns over-represented in STAR elements
  misc_feature (4)..(17): "N" stands for any nucleotide
cccnnnnnnnnnnnnnnggc

SEQ ID NO: 757 - DNA, 9 bp, Artificial Sequence
  Dyad patterns over-represented in STAR elements
  misc_feature (4)..(6): "N" stands for any nucleotide
aggnnnccg

SEQ ID NO: 758 - DNA, 6 bp, Artificial Sequence
  Dyad patterns over-represented in STAR elements
caccgc

SEQ ID NO: 759 - DNA, 24 bp, Artificial Sequence
  Dyad patterns over-represented in STAR elements
  misc_feature (4)..(21): "N" stands for any nucleotide
cggnnnnnnnnnnnnnnnnnncag

SEQ ID NO: 760 - DNA, 7 bp, Artificial Sequence
  Dyad patterns over-represented in STAR elements
  misc_feature (4)..(4): "N" stands for any nucleotide
agcngcc

SEQ ID NO: 761 - DNA, 24 bp, Artificial Sequence
  Dyad patterns over-represented in STAR elements
  misc_feature (4)..(21): "N" stands for any nucleotide
cgcnnnnnnnnnnnnnnnnnnggc

SEQ ID NO: 762 - DNA, 11 bp, Artificial Sequence
  Dyad patterns over-represented in STAR elements
  misc_feature (4)..(8): "N" stands for any nucleotide
cccnnnnnagg

SEQ ID NO: 763 - DNA, 6 bp, Artificial Sequence
  Dyad patterns over-represented in STAR elements
aacgcg

SEQ ID NO: 764 - DNA, 16 bp, Artificial Sequence
  Dyad patterns over-represented in STAR elements
  misc_feature (4)..(13): "N" stands for any nucleotide
cccnnnnnnnnnncca

SEQ ID NO: 765 - DNA, 19 bp, Artificial Sequence
  Dyad patterns over-represented in STAR elements
  misc_feature (4)..(16): "N" stands for any nucleotide
cgcnnnnnnnnnnnnngag

SEQ ID NO: 766 - DNA, 13 bp, Artificial Sequence
  Dyad patterns over-represented in STAR elements
  misc_feature (4)..(10): "N" stands for any nucleotide
cgcnnnnnnngcc

SEQ ID NO: 767 - DNA, 15 bp, Artificial Sequence
  Dyad patterns over-represented in STAR elements
  misc_feature (4)..(12): "N" stands for any nucleotide
cccnnnnnnnnnccg

SEQ ID NO: 768 - DNA, 22 bp, Artificial Sequence
  Dyad patterns over-represented in STAR elements
  misc_feature (4)..(19): "N" stands for any nucleotide
cgcnnnnnnnnnnnnnnnnccc

SEQ ID NO: 769 - DNA, 19 bp, Artificial Sequence
  Dyad patterns over-represented in STAR elements
  misc_feature (4)..(16): "N" stands for any nucleotide
gaannnnnnnnnnnnncgc

SEQ ID NO: 770 - DNA, 9 bp, Artificial Sequence
  Dyad patterns over-represented in STAR elements
  misc_feature (4)..(6): "N" stands for any nucleotide
ggcnnnccc

SEQ ID NO: 771 - DNA, 17 bp, Artificial Sequence
  Dyad patterns over-represented in STAR elements
  misc_feature (4)..(14): "N" stands for any nucleotide
tccnnnnnnnnnnncca

SEQ ID NO: 772 - DNA, 6 bp, Artificial Sequence
  Dyad patterns over-represented in STAR elements
cacccc

SEQ ID NO: 773 - DNA, 22 bp, Artificial Sequence
  Dyad patterns over-represented in STAR elements
  misc_feature (4)..(19): "N" stands for any nucleotide
cgcnnnnnnnnnnnnnnnnccg

SEQ ID NO: 774 - DNA, 21 bp, Artificial Sequence
  Dyad patterns over-represented in STAR elements
  misc_feature (4)..(18): "N" stands for any nucleotide
cggnnnnnnnnnnnnnnnagc

SEQ ID NO: 775 - DNA, 18 bp, Artificial Sequence
  Dyad patterns over-represented in STAR elements
  misc_feature (4)..(15): "N" stands for any nucleotide
cccnnnnnnnnnnnngcg

SEQ ID NO: 776 - DNA, 15 bp, Artificial Sequence
  Dyad patterns over-represented in STAR elements
  misc_feature (4)..(12): "N" stands for any nucleotide
cccnnnnnnnnngag

SEQ ID NO: 777 - DNA, 26 bp, Artificial Sequence
  Dyad patterns over-represented in STAR elements
  misc_feature (4)..(23): "N" stands for any nucleotide
ccgnnnnnnnnnnnnnnnnnnnntcc

SEQ ID NO: 778 - DNA, 6 bp, Artificial Sequence
  Dyad patterns over-represented in STAR elements
cgccgc

SEQ ID NO: 779 - DNA, 13 bp, Artificial Sequence
  Dyad patterns over-represented in STAR elements
  misc_feature (4)..(10): "N" stands for any nucleotide
atgnnnnnnncgg

SEQ ID NO: 780 - DNA, 26 bp, Artificial Sequence
  Dyad patterns over-represented in STAR elements
  misc_feature (4)..(23): "N" stands for any nucleotide
gggnnnnnnnnnnnnnnnnnnnngca

SEQ ID NO: 781 - DNA, 10 bp, Artificial Sequence
  Dyad patterns over-represented in STAR elements
  misc_feature (4)..(7): "N" stands for any nucleotide
cggnnnnggc

SEQ ID NO: 782 - DNA, 22 bp, Artificial Sequence
  Dyad patterns over-represented in STAR elements
  misc_feature (4)..(19): "N" stands for any nucleotide
cggnnnnnnnnnnnnnnnnagc

SEQ ID NO: 783 - DNA, 11 bp, Artificial Sequence
  Dyad patterns over-represented in STAR elements
  misc_feature (4)..(8): "N" stands for any nucleotide
cggnnnnnggc

SEQ ID NO: 784 - DNA, 6 bp, Artificial Sequence
  Dyad patterns over-represented in STAR elements
gcggga

SEQ ID NO: 785 - DNA, 26 bp, Artificial Sequence
  Dyad patterns over-represented in STAR elements
  misc_feature (4)..(23): "N" stands for any nucleotide
ggcnnnnnnnnnnnnnnnnnnnncac

SEQ ID NO: 786 - DNA, 15 bp, Artificial Sequence
  Dyad patterns over-represented in STAR elements
  misc_feature (4)..(12): "N" stands for any nucleotide
cccnnnnnnnnnccc

SEQ ID NO: 787 - DNA, 23 bp, Artificial Sequence
  Dyad patterns over-represented in STAR elements
  misc_feature (4)..(20): "N" stands for any nucleotide
accnnnnnnnnnnnnnnnnnggc

SEQ ID NO: 788 - DNA, 12 bp, Artificial Sequence
  Dyad patterns over-represented in STAR elements
  misc_feature (4)..(9): "N" stands for any nucleotide
cccnnnnnncga

SEQ ID NO: 789 - DNA, 16 bp, Artificial Sequence
  Dyad patterns over-represented in STAR elements
  misc_feature (4)..(13): "N" stands for any nucleotide
aagnnnnnnnnnncgg

SEQ ID NO: 790 - DNA, 23 bp, Artificial Sequence
  Dyad patterns over-represented in STAR elements
  misc_feature (4)..(20): "N" stands for any nucleotide
cgcnnnnnnnnnnnnnnnnncac

SEQ ID NO: 791 - DNA, 22 bp, Artificial Sequence
  Dyad patterns over-represented in STAR elements
  misc_feature (4)..(19): "N" stands for any nucleotide
cccnnnnnnnnnnnnnnnncgg

SEQ ID NO: 792 - DNA, 24 bp, Artificial Sequence
  Dyad patterns over-represented in STAR elements
  misc_feature (4)..(21): "N" stands for any nucleotide
gacnnnnnnnnnnnnnnnnnnggc

SEQ ID NO: 793 - DNA, 21 bp, Artificial Sequence
  Dyad patterns over-represented in STAR elements
  misc_feature (4)..(18): "N" stands for any nucleotide
gggnnnnnnnnnnnnnnngac

SEQ ID NO: 794 - DNA, 10 bp, Artificial Sequence
  Dyad patterns over-represented in STAR elements
  misc_feature (4)..(7): "N" stands for any nucleotide
gccnnnntcc

SEQ ID NO: 795 - DNA, 21 bp, Artificial Sequence
  Dyad patterns over-represented in STAR elements
  misc_feature (4)..(18): "N" stands for any nucleotide
ggcnnnnnnnnnnnnnnnccc

SEQ ID NO: 796 - DNA, 18 bp, Artificial Sequence
  Dyad patterns over-represented in STAR elements
  misc_feature (4)..(15): "N" stands for any nucleotide
cagnnnnnnnnnnnncgc

SEQ ID NO: 797 - DNA, 9 bp, Artificial Sequence
  Dyad patterns over-represented in STAR elements
  misc_feature (4)..(6): "N" stands for any nucleotide
ccannngcg

SEQ ID NO: 798 - DNA, 22 bp, Artificial Sequence
  Dyad patterns over-represented in STAR elements
  misc_feature (4)..(19): "N" stands for any nucleotide
ccgnnnnnnnnnnnnnnnngag

SEQ ID NO: 799 - DNA, 8 bp, Artificial Sequence
  Dyad patterns over-represented in STAR elements
  misc_feature (4)..(5): "N" stands for any nucleotide
agcnncgc

SEQ ID NO: 800 - DNA, 10 bp, Artificial Sequence
  Dyad patterns over-represented in STAR elements
  misc_feature (4)..(7): "N" stands for any nucleotide
gagnnnnccc

SEQ ID NO: 801 - DNA, 9 bp, Artificial Sequence
  Dyad patterns over-represented in STAR elements
  misc_feature (4)..(6): "N" stands for any nucleotide
aggnnncgc

SEQ ID NO: 802 - DNA, 19 bp, Artificial Sequence
  Dyad patterns over-represented in STAR elements
  misc_feature (4)..(16): "N" stands for any nucleotide
cacnnnnnnnnnnnnnagg

SEQ ID NO: 803 - DNA, 10 bp, Artificial Sequence
  Dyad patterns over-represented in STAR elements
  misc_feature (4)..(7): "N" stands for any nucleotide
cccnnnncag

SEQ ID NO: 804 - DNA, 8 bp, Artificial Sequence
  Dyad patterns over-represented in STAR elements
  misc_feature (4)..(5): "N" stands for any nucleotide
cccnngaa

SEQ ID NO: 805 - DNA, 25 bp, Artificial Sequence
  Dyad patterns over-represented in STAR elements
  misc_feature (4)..(22): "N" stands for any nucleotide
cgcnnnnnnnnnnnnnnnnnnngag

SEQ ID NO: 806 - DNA, 24 bp, Artificial Sequence
  Dyad patterns over-represented in STAR elements
  misc_feature (4)..(21): "N" stands for any nucleotide
acgnnnnnnnnnnnnnnnnnnggg

SEQ ID NO: 807 - DNA, 10 bp, Artificial Sequence
  Dyad patterns over-represented in STAR elements
  misc_feature (4)..(7): "N" stands for any nucleotide
cccnnnnggc

SEQ ID NO: 808 - DNA, 15 bp, Artificial Sequence
  Dyad patterns over-represented in STAR elements
  misc_feature (4)..(12): "N" stands for any nucleotide
cggnnnnnnnnngag

SEQ ID NO: 809 - DNA, 9 bp, Artificial Sequence
  Dyad patterns over-represented in STAR elements
  misc_feature (4)..(6): "N" stands for any nucleotide
cccnnnggg

SEQ ID NO: 810 - DNA, 10 bp, Artificial Sequence
  Dyad patterns over-represented in STAR elements
  misc_feature (4)..(7): "N" stands for any nucleotide
gagnnnnggc

SEQ ID NO: 811 - DNA, 11 bp, Artificial Sequence
  Dyad patterns over-represented in STAR elements
  misc_feature (4)..(8): "N" stands for any nucleotide
cgcnnnnngag

SEQ ID NO: 812 - DNA, 26 bp, Artificial Sequence
  Dyad patterns over-represented in STAR elements
  misc_feature (4)..(23): "N" stands for any nucleotide
ccgnnnnnnnnnnnnnnnnnnnnagg

SEQ ID NO: 813 - DNA, 21 bp, Artificial Sequence
  Dyad patterns over-represented in STAR elements
  misc_feature (4)..(18): "N" stands for any nucleotide
cccnnnnnnnnnnnnnnnccc

SEQ ID NO: 814 - DNA, 23 bp, Artificial Sequence
  Dyad patterns over-represented in STAR elements
  misc_feature (4)..(20): "N" stands for any nucleotide
aggnnnnnnnnnnnnnnnnnccg

SEQ ID NO: 815 - DNA, 12 bp, Artificial Sequence
  Dyad patterns over-represented in STAR elements
  misc_feature (4)..(9): "N" stands for any nucleotide
aggnnnnnnggg

SEQ ID NO: 816 - DNA, 26 bp, Artificial Sequence
  Dyad patterns over-represented in STAR elements
  misc_feature (4)..(23): "N" stands for any nucleotide
ggcnnnnnnnnnnnnnnnnnnnnccc

SEQ ID NO: 817 - DNA, 23 bp, Artificial Sequence
  Dyad patterns over-represented in STAR elements
  misc_feature (4)..(20): "N" stands for any nucleotide
gcannnnnnnnnnnnnnnnncgc

SEQ ID NO: 818 - DNA, 17 bp, Artificial Sequence
  Dyad patterns over-represented in STAR elements
  misc_feature (4)..(14): "N" stands for any nucleotide
cgannnnnnnnnnnacg

SEQ ID NO: 819 - DNA, 8 bp, Artificial Sequence
  Dyad patterns over-represented in STAR elements
  misc_feature (4)..(5): "N" stands for any nucleotide
cgcnngga

SEQ ID NO: 820 - DNA, 11 bp, Artificial Sequence
  Dyad patterns over-represented in STAR elements
  misc_feature (4)..(8): "N" stands for any nucleotide
ctgnnnnnccc

SEQ ID NO: 821 - DNA, 26 bp, Artificial Sequence
  Dyad patterns over-represented in STAR elements
  misc_feature (4)..(23): "N" stands for any nucleotide
tccnnnnnnnnnnnnnnnnnnnncca

SEQ ID NO: 822 - DNA, 8 bp, Artificial Sequence
  Dyad patterns over-represented in STAR elements
  misc_feature (4)..(5): "N" stands for any nucleotide
ccannggg

SEQ ID NO: 823 - DNA, 21 bp, Artificial Sequence
  Dyad patterns over-represented in STAR elements
  misc_feature (4)..(18): "N" stands for any nucleotide
ccgnnnnnnnnnnnnnnngcg

SEQ ID NO: 824 - DNA, 11 bp, Artificial Sequence
  Dyad patterns over-represented in STAR elements
  misc_feature (4)..(8): "N" stands for any nucleotide
ccannnnnggg

SEQ ID NO: 825 - DNA, 7 bp, Artificial Sequence
  Dyad patterns over-represented in STAR elements
  misc_feature (4)..(4): "N" stands for any nucleotide
cggntgc

SEQ ID NO: 826 - DNA, 20 bp, Artificial Sequence
  Dyad patterns over-represented in STAR elements
  misc_feature (4)..(17): "N" stands for any nucleotide
cccnnnnnnnnnnnnnngcg

SEQ ID NO: 827 - DNA, 6 bp, Artificial Sequence
  Dyad patterns over-represented in STAR elements
cagccg

SEQ ID NO: 828 - DNA, 15 bp, Artificial Sequence
  Dyad patterns over-represented in STAR elements
  misc_feature (4)..(12): "N" stands for any nucleotide
gccnnnnnnnnntcc

SEQ ID NO: 829 - DNA, 26 bp, Artificial Sequence
  Dyad patterns over-represented in STAR elements
  misc_feature (4)..(23): "N" stands for any nucleotide
aggnnnnnnnnnnnnnnnnnnnncgc

SEQ ID NO: 830 - DNA, 12 bp, Artificial Sequence
  Dyad patterns over-represented in STAR elements
  misc_feature (4)..(9): "N" stands for any nucleotide
cccnnnnnngac

SEQ ID NO: 831 - DNA, 17 bp, Artificial Sequence
  Dyad patterns over-represented in STAR elements
  misc_feature (4)..(14): "N" stands for any nucleotide
cggnnnnnnnnnnncca

SEQ ID NO: 832 - DNA, 20 bp, Artificial Sequence
  Dyad patterns over-represented in STAR elements
  misc_feature (4)..(17): "N" stands for any nucleotide
gggnnnnnnnnnnnnnncac

SEQ ID NO: 833 - DNA, 21 bp, Artificial Sequence
  Dyad patterns over-represented in STAR elements
  misc_feature (4)..(18): "N" stands for any nucleotide
gcannnnnnnnnnnnnnncgc

SEQ ID NO: 834 - DNA, 8 bp, Artificial Sequence
  Dyad patterns over-represented in STAR elements
  misc_feature (4)..(5): "N" stands for any nucleotide
cgcnnaca

SEQ ID NO: 835 - DNA, 15 bp, Artificial Sequence
  Dyad patterns over-represented in STAR elements
  misc_feature (4)..(12): "N" stands for any nucleotide
accnnnnnnnnnccc

SEQ ID NO: 836 - DNA, 15 bp, Artificial Sequence
  Dyad patterns over-represented in STAR elements
  misc_feature (4)..(12): "N" stands for any nucleotide
gcgnnnnnnnnncgc

SEQ ID NO: 837 - DNA, 21 bp, Artificial Sequence
  Dyad patterns over-represented in STAR elements
  misc_feature (4)..(18): "N" stands for any nucleotide
cagnnnnnnnnnnnnnnngcg

SEQ ID NO: 838 - DNA, 24 bp, Artificial Sequence
  Dyad patterns over-represented in STAR elements
  misc_feature (4)..(21): "N" stands for any nucleotide
cccnnnnnnnnnnnnnnnnnngtc

SEQ ID NO: 839 - DNA, 9 bp, Artificial Sequence
  Dyad patterns over-represented in STAR elements
  misc_feature (4)..(6): "N" stands for any nucleotide
gcgnnnccc

SEQ ID NO: 840 - DNA, 17 bp, Artificial Sequence
  Dyad patterns over-represented in STAR elements
  misc_feature (4)..(14): "N" stands for any nucleotide
cggnnnnnnnnnnngcc

SEQ ID NO: 841 - DNA, 7 bp, Artificial Sequence
  Dyad patterns over-represented in STAR elements
  misc_feature (4)..(4): "N" stands for any nucleotide
cccncgg

SEQ ID NO: 842 - DNA, 10 bp, Artificial Sequence
  Dyad patterns over-represented in STAR elements
  misc_feature (4)..(7): "N" stands for any nucleotide
gccnnnncca

SEQ ID NO: 843 - DNA, 10 bp, Artificial Sequence
  Dyad patterns over-represented in STAR elements
  misc_feature (4)..(7): "N" stands for any nucleotide
cccnnnnccg

SEQ ID NO: 844 - DNA, 8 bp, Artificial Sequence
  Dyad patterns over-represented in STAR elements
  misc_feature (4)..(5): "N" stands for any nucleotide
cgtnngca

SEQ ID NO: 845 - DNA, 13 bp, Artificial Sequence
  Dyad patterns over-represented in STAR elements
  misc_feature (4)..(10): "N" stands for any nucleotide
agcnnnnnnntcg

SEQ ID NO: 846 - DNA, 21 bp, Artificial Sequence
  Dyad patterns over-represented in STAR elements
  misc_feature (4)..(18): "N" stands for any nucleotide
ccgnnnnnnnnnnnnnnngaa

SEQ ID NO: 847 - DNA, 11 bp, Artificial Sequence
  Dyad patterns over-represented in STAR elements
  misc_feature (4)..(8): "N" stands for any nucleotide
accnnnnnccc

SEQ ID NO: 848 - DNA, 20 bp, Artificial Sequence
  Dyad patterns over-represented in STAR elements
  misc_feature (4)..(17): "N" stands for any nucleotide
cgcnnnnnnnnnnnnnngag

SEQ ID NO: 849 - DNA, 13 bp, Artificial Sequence
  Dyad patterns over-represented in STAR elements
  misc_feature (4)..(10): "N" stands for any nucleotide
cccnnnnnnncgc

SEQ ID NO: 850 - DNA, 18 bp, Artificial Sequence
  Dyad patterns over-represented in STAR elements
  misc_feature (4)..(15): "N" stands for any nucleotide
gagnnnnnnnnnnnncgc

SEQ ID NO: 851 - DNA, 23 bp, Artificial Sequence
  Dyad patterns over-represented in STAR elements
  misc_feature (4)..(20): "N" stands for any nucleotide
ggcnnnnnnnnnnnnnnnnnccc

SEQ ID NO: 852 - DNA, 17 bp, Artificial Sequence
  Dyad patterns over-represented in STAR elements
  misc_feature (4)..(14): "N" stands for any nucleotide
acgnnnnnnnnnnnctc

SEQ ID NO: 853 - DNA, 15 bp, Artificial Sequence
  Dyad patterns over-represented in STAR elements
  misc_feature (4)..(12): "N" stands for any nucleotide
acannnnnnnnncgg

SEQ ID NO: 854 - DNA, 13 bp, Artificial Sequence
  Dyad patterns over-represented in STAR elements
  misc_feature (4)..(10): "N" stands for any nucleotide
ctgnnnnnnnccc

SEQ ID NO: 855 - DNA, 8 bp, Artificial Sequence
  Dyad patterns over-represented in STAR elements
  misc_feature (4)..(5): "N" stands for any nucleotide
cccnngcc

SEQ ID NO: 856 - DNA, 8 bp, Artificial Sequence
  Dyad patterns over-represented in STAR elements
  misc_feature (4)..(5): "N" stands for any nucleotide
cggnngca

SEQ ID NO: 857 - DNA, 6 bp, Artificial Sequence
  Dyad patterns over-represented in STAR elements
ccctgc

SEQ ID NO: 858 - DNA, 13 bp, Artificial Sequence
  Dyad patterns over-represented in STAR elements
  misc_feature (4)..(10): "N" stands for any nucleotide
cgcnnnnnnnacc

SEQ ID NO: 859 - DNA, 8 bp, Artificial Sequence
  Dyad patterns over-represented in STAR elements
  misc_feature (4)..(5): "N" stands for any nucleotide
gcanngcc

SEQ ID NO: 860 - DNA, 14 bp, Artificial Sequence
  Dyad patterns over-represented in STAR elements
  misc_feature (4)..(11): "N" stands for any nucleotide
gcgnnnnnnnncca

SEQ ID NO: 861 - DNA, 6 bp, Artificial Sequence
  Dyad patterns over-represented in STAR elements
agccgc

SEQ ID NO: 862 - DNA, 8 bp, Artificial Sequence
  Dyad patterns over-represented in STAR elements
  misc_feature (4)..(5): "N" stands for any nucleotide
gcgnngca

SEQ ID NO: 863 - DNA, 8 bp, Artificial Sequence
  Dyad patterns over-represented in STAR elements
  misc_feature (4)..(5): "N" stands for any nucleotide
ccgnngtc

SEQ ID NO: 864 - DNA, 9 bp, Artificial Sequence
  Dyad patterns over-represented in STAR elements
  misc_feature (4)..(6): "N" stands for any nucleotide
ccgnnnaca

SEQ ID NO: 865 - DNA, 19 bp, Artificial Sequence
  Dyad patterns over-represented in STAR elements
  misc_feature (4)..(16): "N" stands for any nucleotide
acgnnnnnnnnnnnnntgg

SEQ ID NO: 866 - DNA, 14 bp, Artificial Sequence
  Dyad patterns over-represented in STAR elements
  misc_feature (4)..(11): "N" stands for any nucleotide
ccannnnnnnncgc

SEQ ID NO: 867 - DNA, 15 bp, Artificial Sequence
  Dyad patterns over-represented in STAR elements
  misc_feature (4)..(12): "N" stands for any nucleotide
ccgnnnnnnnnnggc

SEQ ID NO: 868 - DNA, 11 bp, Artificial Sequence
  Dyad patterns over-represented in STAR elements
  misc_feature (4)..(8): "N" stands for any nucleotide
ccannnnnccg

SEQ ID NO: 869 - DNA, 9 bp, Artificial Sequence
  Dyad patterns over-represented in STAR elements
  misc_feature (4)..(6): "N" stands for any nucleotide
aggnnnggg

SEQ ID NO: 870 - DNA, 8 bp, Artificial Sequence
  Dyad patterns over-represented in STAR elements
  misc_feature (4)..(5): "N" stands for any nucleotide
cagnnggc

SEQ ID NO: 871 - DNA, 14 bp, Artificial Sequence
  Dyad patterns over-represented in STAR elements
  misc_feature (4)..(11): "N" stands for any nucleotide
cccnnnnnnnncag

SEQ ID NO: 872 - DNA, 11 bp, Artificial Sequence
  Dyad patterns over-represented in STAR elements
  misc_feature (4)..(8): "N" stands for any nucleotide
agcnnnnncag

SEQ ID NO: 873 - DNA, 22 bp, Artificial Sequence
  Dyad patterns over-represented in STAR elements
  misc_feature (4)..(19): "N" stands for any nucleotide
cggnnnnnnnnnnnnnnnngcc

SEQ ID NO: 874 - DNA, 21 bp, Artificial Sequence
  Dyad patterns over-represented in STAR elements
  misc_feature (4)..(18): "N" stands for any nucleotide
gcgnnnnnnnnnnnnnnnccc

SEQ ID NO: 875 - DNA, 17 bp, Artificial Sequence
  Dyad patterns over-represented in STAR elements
  misc_feature (4)..(14): "N" stands for any nucleotide
cccnnnnnnnnnnngcc

SEQ ID NO: 876 - DNA, 8 bp, Artificial Sequence
  Dyad patterns over-represented in STAR elements
  misc_feature (4)..(5): "N" stands for any nucleotide
cgannacg

SEQ ID NO: 877 - DNA, 10 bp, Artificial Sequence
  Dyad patterns over-represented in STAR elements
  misc_feature (4)..(7): "N" stands for any nucleotide
cggnnnngcc

SEQ ID NO: 878 - DNA, 12 bp, Artificial Sequence
  Dyad patterns over-represented in STAR elements
  misc_feature (4)..(9): "N" stands for any nucleotide
cacnnnnnncgc

SEQ ID NO: 879 - DNA, 11 bp, Artificial Sequence
  Dyad patterns over-represented in STAR elements
  misc_feature (4)..(8): "N" stands for any nucleotide
cggnnnnnacg

SEQ ID NO: 880 - DNA, 10 bp, Artificial Sequence
  Dyad patterns over-represented in STAR elements
  misc_feature (4)..(7): "N" stands for any nucleotide
ctgnnnngcc

SEQ ID NO: 881 - DNA, 24 bp, Artificial Sequence
  Dyad patterns over-represented in STAR elements
  misc_feature (4)..(21): "N" stands for any nucleotide
gggnnnnnnnnnnnnnnnnnncga

SEQ ID NO: 882 - DNA, 14 bp, Artificial Sequence
  Dyad patterns over-represented in STAR elements
  misc_feature (4)..(11): "N" stands for any nucleotide
cctnnnnnnnncgc

SEQ ID NO: 883 - DNA, 10 bp, Artificial Sequence
  Dyad patterns over-represented in STAR elements
  misc_feature (4)..(7): "N" stands for any nucleotide
gccnnnnccc

SEQ ID NO: 884 - DNA, 16 bp, Artificial Sequence
  Dyad patterns over-represented in STAR elements
  misc_feature (4)..(13): "N" stands for any nucleotide
cggnnnnnnnnnngcc

SEQ ID NO: 885 - DNA, 11 bp, Artificial Sequence
  Dyad patterns over-represented in STAR elements
  misc_feature (4)..(8): "N" stands for any nucleotide
gccnnnnngga

SEQ ID NO: 886 - DNA, 13 bp, Artificial Sequence
  Dyad patterns over-represented in STAR elements
  misc_feature (4)..(10): "N" stands for any nucleotide
accnnnnnnngcg

SEQ ID NO: 887 - DNA, 14 bp, Artificial Sequence
  Dyad patterns over-represented in STAR elements
  misc_feature (4)..(11): "N" stands for any nucleotide
cccnnnnnnnncgc

SEQ ID NO: 888 - DNA, 11 bp, Artificial Sequence
  Dyad patterns over-represented in STAR elements
  misc_feature (4)..(8): "N" stands for any nucleotide
cagnnnnnccc

SEQ ID NO: 889 - DNA, 20 bp, Artificial Sequence
  Dyad patterns over-represented in STAR elements
  misc_feature (4)..(17): "N" stands for any nucleotide
cacnnnnnnnnnnnnnngga

SEQ ID NO: 890 - DNA, 7 bp, Artificial Sequence
  Dyad patterns over-represented in STAR elements
  misc_feature (4)..(4): "N" stands for any nucleotide
cccngcc

SEQ ID NO: 891 - DNA, 11 bp, Artificial Sequence
  Dyad patterns over-represented in STAR elements
  misc_feature (4)..(8): "N" stands for any nucleotide
cccnnnnnagc

SEQ ID NO: 892 - DNA, 11 bp, Artificial Sequence
  Dyad patterns over-represented in STAR elements
  misc_feature (4)..(8): "N" stands for any nucleotide
ggcnnnnngga

SEQ ID NO: 893 - DNA, 23 bp, Artificial Sequence
  Dyad patterns over-represented in STAR elements
  misc_feature (4)..(20): "N" stands for any nucleotide
cgannnnnnnnnnnnnnnnngag

SEQ ID NO: 894 - DNA, 13 bp, Artificial Sequence
  Dyad patterns over-represented in STAR elements
  misc_feature (4)..(10): "N" stands for any nucleotide
cgcnnnnnnnaca

SEQ ID NO: 895 - DNA, 19 bp, Artificial Sequence
  Dyad patterns over-represented in STAR elements
  misc_feature (4)..(16): "N" stands for any nucleotide
ccannnnnnnnnnnnnccc

SEQ ID NO: 896 - DNA, 26 bp, Artificial Sequence
  Dyad patterns over-represented in STAR elements
  misc_feature (4)..(23): "N" stands for any nucleotide
cggnnnnnnnnnnnnnnnnnnnnggc

SEQ ID NO: 897 - DNA, 23 bp, Artificial Sequence
  Dyad patterns over-represented in STAR elements
  misc_feature (4)..(20): "N" stands for any nucleotide
cccnnnnnnnnnnnnnnnnngcc

SEQ ID NO: 898 - DNA, 16 bp, Artificial Sequence
  Dyad patterns over-represented in STAR elements
  misc_feature (4)..(13): "N" stands for any nucleotide
cctnnnnnnnnnnccg

SEQ ID NO: 899 - DNA, 14 bp, Artificial Sequence
  Dyad patterns over-represented in STAR elements
  misc_feature (4)..(11): "N" stands for any nucleotide
cccnnnnnnnnccg

SEQ ID NO: 900 - DNA, 9 bp, Artificial Sequence
  Dyad patterns over-represented in STAR elements
  misc_feature (4)..(6): "N" stands for any nucleotide
cgcnnngag

SEQ ID NO: 901 - DNA, 13 bp, Artificial Sequence
  Dyad patterns over-represented in STAR elements
  misc_feature (4)..(10): "N" stands for any nucleotide
cgcnnnnnnnaag

SEQ ID NO: 902 - DNA, 17 bp, Artificial Sequence
  Dyad patterns over-represented in STAR elements
  misc_feature (4)..(14): "N" stands for any nucleotide
cggnnnnnnnnnnngga

SEQ ID NO: 903 - DNA, 21 bp, Artificial Sequence
  Dyad patterns over-represented in STAR elements
  misc_feature (4)..(18): "N" stands for any nucleotide
ccgnnnnnnnnnnnnnnnccg

SEQ ID NO: 904 - DNA, 9 bp, Artificial Sequence
  Dyad patterns over-represented in STAR elements
  misc_feature (4)..(6): "N" stands for any nucleotide
cccnnngca

SEQ ID NO: 905 - DNA, 8 bp, Artificial Sequence
  Dyad patterns over-represented in STAR elements
  misc_feature (4)..(5): "N" stands for any nucleotide
cggnncag

SEQ ID NO: 906 - DNA, 8 bp, Artificial Sequence
  Dyad patterns over-represented in STAR elements
  misc_feature (4)..(5): "N" stands for any nucleotide
aggnnccg

SEQ ID NO: 907 - DNA, 10 bp, Artificial Sequence
  Dyad patterns over-represented in STAR elements
  misc_feature (4)..(7): "N" stands for any nucleotide
cccnnnncac

SEQ ID NO: 908 - DNA, 25 bp, Artificial Sequence
  Dyad patterns over-represented in STAR elements
  misc_feature (4)..(22): "N" stands for any nucleotide
ggannnnnnnnnnnnnnnnnnnccc

SEQ ID NO: 909 - DNA, 14 bp, Artificial Sequence
  Dyad patterns over-represented in STAR elements
  misc_feature (4)..(11): "N" stands for any nucleotide
cccnnnnnnnncac

SEQ ID NO: 910 - DNA, 12 bp, Artificial Sequence
  Dyad patterns over-represented in STAR elements
  misc_feature (4)..(9): "N" stands for any nucleotide
accnnnnnnccg

SEQ ID NO: 911 - DNA, 12 bp, Artificial Sequence
  Dyad patterns over-represented in STAR elements
  misc_feature (4)..(9): "N" stands for any nucleotide
cccnnnnnnggc

SEQ ID NO: 912 - DNA, 12 bp, Artificial Sequence
  Dyad patterns over-represented in STAR elements
  misc_feature (4)..(9): "N" stands for any nucleotide
cccnnnnnnccg

SEQ ID NO: 913 - DNA, 20 bp, Artificial Sequence
  Dyad patterns over-represented in STAR elements
  misc_feature (4)..(17): "N" stands for any nucleotide
cgcnnnnnnnnnnnnnngcc

SEQ ID NO: 914 - DNA, 11 bp, Artificial Sequence
  Dyad patterns over-represented in STAR elements
  misc_feature (4)..(8): "N" stands for any nucleotide
ccgnnnnntcc

SEQ ID NO: 915 - DNA, 12 bp, Artificial Sequence
  Dyad patterns over-represented in STAR elements
  misc_feature (4)..(9): "N" stands for any nucleotide
gccnnnnnngcc

SEQ ID NO: 916 - DNA, 13 bp, Artificial Sequence
  Dyad patterns over-represented in STAR elements
  misc_feature (4)..(10): "N" stands for any nucleotide
cggnnnnnnngga

SEQ ID NO: 917 - DNA, 12 bp, Artificial Sequence
  Dyad patterns over-represented in STAR elements
  misc_feature (4)..(9): "N" stands for any nucleotide
gggnnnnnngga

SEQ ID NO: 918 - DNA, 18 bp, Artificial Sequence
  Dyad patterns over-represented in STAR elements
  misc_feature (4)..(15): "N" stands for any nucleotide
gccnnnnnnnnnnnntcc

SEQ ID NO: 919 - DNA, 22 bp, Artificial Sequence
  Dyad patterns over-represented in STAR elements
  misc_feature (4)..(19): "N" stands for any nucleotide
agtnnnnnnnnnnnnnnnnccg

SEQ ID NO: 920 - DNA, 25 bp, Artificial Sequence
  Dyad patterns over-represented in STAR elements
  misc_feature (4)..(22): "N" stands for any nucleotide
ggcnnnnnnnnnnnnnnnnnnngcc

SEQ ID NO: 921 - DNA, 9 bp, Artificial Sequence
  Dyad patterns over-represented in STAR elements
  misc_feature (4)..(6): "N" stands for any nucleotide
ccgnnnccg

SEQ ID NO: 922 - DNA, 14 bp, Artificial Sequence
  Dyad patterns over-represented in STAR elements
  misc_feature (4)..(11): "N" stands for any nucleotide
cccnnnnnnnnacc

SEQ ID NO: 923 - DNA, 21 bp, Artificial Sequence
  Dyad patterns over-represented in STAR elements
  misc_feature (4)..(18): "N" stands for any nucleotide
cagnnnnnnnnnnnnnnngcc

SEQ ID NO: 924 - DNA, 23 bp, Artificial Sequence
  Dyad patterns over-represented in STAR elements
  misc_feature (4)..(20): "N" stands for any nucleotide
cccnnnnnnnnnnnnnnnnncgg

SEQ ID NO: 925 - DNA, 7 bp, Artificial Sequence
  Dyad patterns over-represented in STAR elements
  misc_feature (4)..(4): "N" stands for any nucleotide
gcgncca

SEQ ID NO: 926 - DNA, 20 bp, Artificial Sequence
  Dyad patterns over-represented in STAR elements
  misc_feature (4)..(17): "N" stands for any nucleotide
cccnnnnnnnnnnnnnncag

SEQ ID NO: 927 - DNA, 14 bp, Artificial Sequence
  Dyad patterns over-represented in STAR elements
  misc_feature (4)..(11): "N" stands for any nucleotide
cccnnnnnnnnccc

SEQ ID NO: 928 - DNA, 18 bp, Artificial Sequence
  Dyad patterns over-represented in STAR elements
  misc_feature (4)..(15): "N" stands for any nucleotide
acannnnnnnnnnnngcg

SEQ ID NO: 929 - DNA, 10 bp, Artificial Sequence
  Dyad patterns over-represented in STAR elements
  misc_feature (4)..(7): "N" stands for any nucleotide
aggnnnnccg

SEQ ID NO: 930 - DNA, 19 bp, Artificial Sequence
  Dyad patterns over-represented in STAR elements
  misc_feature (4)..(16): "N" stands for any nucleotide
cgcnnnnnnnnnnnnngcc

SEQ ID NO: 931 - DNA, 8 bp, Artificial Sequence
  Dyad patterns over-represented in STAR elements
  misc_feature (4)..(5): "N" stands for any nucleotide
gagnncgc

SEQ ID NO: 932 - DNA, 15 bp, Artificial Sequence
  Dyad patterns over-represented in STAR elements
  misc_feature (4)..(12): "N" stands for any nucleotide
cccnnnnnnnnngcg

SEQ ID NO: 933 - DNA, 23 bp, Artificial Sequence
  Dyad patterns over-represented in STAR elements
  misc_feature (4)..(20): "N" stands for any nucleotide
cgcnnnnnnnnnnnnnnnnnaca

SEQ ID NO: 934 - DNA, 23 bp, Artificial Sequence
  Dyad patterns over-represented in STAR elements
  misc_feature (4)..(20): "N" stands for any nucleotide
gcgnnnnnnnnnnnnnnnnncca

SEQ ID NO: 935 - DNA, 24 bp, Artificial Sequence
  Dyad patterns over-represented in STAR elements
  misc_feature (4)..(21): "N" stands for any nucleotide
aagnnnnnnnnnnnnnnnnnnccg

SEQ ID NO: 936 - DNA, 7 bp, Artificial Sequence
  Dyad patterns over-represented in STAR elements
  misc_feature (4)..(4): "N" stands for any nucleotide
cgcngga

SEQ ID NO: 937 - DNA, 7 bp, Artificial Sequence
  Dyad patterns over-represented in STAR elements
  misc_feature (4)..(4): "N" stands for any nucleotide
ccanccc

SEQ ID NO: 938 - DNA, 24 bp, Artificial Sequence
  Dyad patterns over-represented in STAR elements
  misc_feature (4)..(21): "N" stands for any nucleotide
cgtnnnnnnnnnnnnnnnnnntgc

SEQ ID NO: 939 - DNA, 20 bp, Artificial Sequence
  Dyad patterns over-represented in STAR elements
  misc_feature (4)..(17): "N" stands for any nucleotide
tccnnnnnnnnnnnnnncga

SEQ ID NO: 940 - DNA, 11 bp, Artificial Sequence
  Dyad patterns over-represented in STAR elements
  misc_feature (4)..(8): "N" stands for any nucleotide
cacnnnnnggg

SEQ ID NO: 941 - DNA, 18 bp, Artificial Sequence
  Dyad patterns over-represented in STAR elements
  misc_feature (4)..(15): "N" stands for any nucleotide
ccgnnnnnnnnnnnngca

SEQ ID NO: 942 - DNA, 12 bp, Artificial Sequence
  Dyad patterns over-represented in STAR elements
  misc_feature (4)..(9): "N" stands for any nucleotide
ctgnnnnnnccc

SEQ ID NO: 943 - DNA, 14 bp, Artificial Sequence
  Dyad patterns over-represented in STAR elements
  misc_feature (4)..(11): "N" stands for any nucleotide
cggnnnnnnnnggc

SEQ ID NO: 944 - DNA, 17 bp, Artificial Sequence
  Dyad patterns over-represented in STAR elements
  misc_feature (4)..(14): "N" stands for any nucleotide
ccannnnnnnnnnnggg

SEQ ID NO: 945 - DNA, 25 bp, Artificial Sequence
  Dyad patterns over-represented in STAR elements
  misc_feature (4)..(22): "N" stands for any nucleotide
acgnnnnnnnnnnnnnnnnnnncaa

SEQ ID NO: 946 - DNA, 26 bp, Artificial Sequence
  Dyad patterns over-represented in STAR elements
  misc_feature (4)..(23): "N" stands for any nucleotide
gggnnnnnnnnnnnnnnnnnnnnccc

SEQ ID NO: 947 - DNA, 10 bp, Artificial Sequence
  Dyad patterns over-represented in STAR elements
  misc_feature (4)..(7): "N" stands for any nucleotide
cgcnnnncag

SEQ ID NO: 948 - DNA, 23 bp, Artificial Sequence
  Dyad patterns over-represented in STAR elements
  misc_feature (4)..(20): "N" stands for any nucleotide
agcnnnnnnnnnnnnnnnnnggg

SEQ ID NO: 949 - DNA, 26 bp, Artificial Sequence
  Dyad patterns over-represented in STAR elements
  misc_feature (4)..(23): "N" stands for any nucleotide
cacnnnnnnnnnnnnnnnnnnnnccg

SEQ ID NO: 950 - DNA, 23 bp, Artificial Sequence
  Dyad patterns over-represented in STAR elements
  misc_feature (4)..(20): "N" stands for any nucleotide
acgnnnnnnnnnnnnnnnnncag

SEQ ID NO: 951 - DNA, 7 bp, Artificial Sequence
  Dyad patterns over-represented in STAR elements
  misc_feature (4)..(4): "N" stands for any nucleotide
aggnccc

SEQ ID NO: 952 - DNA, 18 bp, Artificial Sequence
  Dyad patterns over-represented in STAR elements
  misc_feature (4)..(15): "N" stands for any nucleotide
cgtnnnnnnnnnnnncac

SEQ ID NO: 953 - DNA, 15 bp, Artificial Sequence
  Dyad patterns over-represented in STAR elements
  misc_feature (4)..(12): "N" stands for any nucleotide
cggnnnnnnnnnggc

SEQ ID NO: 954 - DNA, 16 bp, Artificial Sequence
  Dyad patterns over-represented in STAR elements
  misc_feature (4)..(13): "N" stands for any nucleotide
cgcnnnnnnnnnngcg

SEQ ID NO: 955 - DNA, 12 bp, Artificial Sequence
  Dyad patterns over-represented in STAR elements
  misc_feature (4)..(9): "N" stands for any nucleotide
cccnnnnnnctc

SEQ ID NO: 956 - DNA, 16 bp, Artificial Sequence
  Dyad patterns over-represented in STAR elements
  misc_feature (4)..(13): "N" stands for any nucleotide
ccgnnnnnnnnnnagg

SEQ ID NO: 957 - DNA, 24 bp, Artificial Sequence
  Dyad patterns over-represented in STAR elements
  misc_feature (4)..(21): "N" stands for any nucleotide
cccnnnnnnnnnnnnnnnnnncag

SEQ ID NO: 958 - DNA, 23 bp, Artificial Sequence
  Dyad patterns over-represented in STAR elements
  misc_feature (4)..(20): "N" stands for any nucleotide
agcnnnnnnnnnnnnnnnnnccg

SEQ ID NO: 959 - DNA, 15 bp, Artificial Sequence
  Dyad patterns over-represented in STAR elements
  misc_feature (4)..(12): "N" stands for any nucleotide
agcnnnnnnnnngcg

SEQ ID NO: 960 - DNA, 9 bp, Artificial Sequence
  Dyad patterns over-represented in STAR elements
  misc_feature (4)..(6): "N" stands for any nucleotide
ccannnggc

SEQ ID NO: 961 - DNA, 17 bp, Artificial Sequence
  Dyad patterns over-represented in STAR elements
  misc_feature (4)..(14): "N" stands for any nucleotide
cccnnnnnnnnnnnggc

SEQ ID NO: 962 - DNA, 11 bp, Artificial Sequence
  Dyad patterns over-represented in STAR elements
  misc_feature (4)..(8): "N" stands for any nucleotide
acgnnnnngca

SEQ ID NO: 963 - DNA, 20 bp, Artificial Sequence
  Dyad patterns over-represented in STAR elements
  misc_feature (4)..(17): "N" stands for any nucleotide
cccnnnnnnnnnnnnnncgg

SEQ ID NO: 964 - DNA, 11 bp, Artificial Sequence
  Dyad patterns over-represented in STAR elements
  misc_feature (4)..(8): "N" stands for any nucleotide
cccnnnnncca

SEQ ID NO: 965 - DNA, 7 bp, Artificial Sequence
  Dyad patterns over-represented in STAR elements
  misc_feature (4)..(4): "N" stands for any nucleotide
ccgnagg

SEQ ID NO: 966 - DNA, 16 bp, Artificial Sequence
  Dyad patterns over-represented in STAR elements
  misc_feature (4)..(13): "N" stands for any nucleotide
gggnnnnnnnnnngac

SEQ ID NO: 967 - DNA, 21 bp, Artificial Sequence
  Dyad patterns over-represented in STAR elements
  misc_feature (4)..(18): "N" stands for any nucleotide
cgcnnnnnnnnnnnnnnncca

SEQ ID NO: 968 - DNA, 25 bp, Artificial Sequence
  Dyad patterns over-represented in STAR elements
  misc_feature (4)..(22): "N" stands for any nucleotide
cctnnnnnnnnnnnnnnnnnnncgc

SEQ ID NO: 969 - DNA, 9 bp, Artificial Sequence
  Dyad patterns over-represented in STAR elements
  misc_feature (4)..(6): "N" stands for any nucleotide
cgtnnncgc

SEQ ID NO: 970 - DNA, 20 bp, Artificial Sequence
  Dyad patterns over-represented in STAR elements
  misc_feature (4)..(17): "N" stands for any nucleotide
agcnnnnnnnnnnnnnnccg

SEQ ID NO: 971 - DNA, 8 bp, Artificial Sequence
  Dyad patterns over-represented in STAR elements
  misc_feature (4)..(5): "N" stands for any nucleotide
ggcnncga

SEQ ID NO: 972 - DNA, 14 bp, Artificial Sequence
  Dyad patterns over-represented in STAR elements
  misc_feature (4)..(11): "N" stands for any nucleotide
cagnnnnnnnnccc

SEQ ID NO: 973 - DNA, 8 bp, Artificial Sequence
  Dyad patterns over-represented in STAR elements
  misc_feature (4)..(5): "N" stands for any nucleotide
ccgnngac

SEQ ID NO: 974 - DNA, 25 bp, Artificial Sequence
  Dyad patterns over-represented in STAR elements
  misc_feature (4)..(22): "N" stands for any nucleotide
agcnnnnnnnnnnnnnnnnnnnagg

SEQ ID NO: 975 - DNA, 10 bp, Artificial Sequence
  Dyad patterns over-represented in STAR elements
  misc_feature (4)..(7): "N" stands for any nucleotide
cctnnnnggc

SEQ ID NO: 976 - DNA, 17 bp, Artificial Sequence
  Dyad patterns over-represented in STAR elements
  misc_feature (4)..(14): "N" stands for any nucleotide
ccgnnnnnnnnnnnagc

SEQ ID NO: 977 - DNA, 10 bp, Artificial Sequence
  Dyad patterns over-represented in STAR elements
  misc_feature (4)..(7): "N" stands for any nucleotide
cacnnnncgc

SEQ ID NO: 978 - DNA, 7 bp, Artificial Sequence
  Dyad patterns over-represented in STAR elements
  misc_feature (4)..(4): "N" stands for any nucleotide
ccgnccc

SEQ ID NO: 979 - DNA, 19 bp, Artificial Sequence
  Dyad patterns over-represented in STAR elements
  misc_feature (4)..(16): "N" stands for any nucleotide
ctgnnnnnnnnnnnnnggc

SEQ ID NO: 980 - DNA, 22 bp, Artificial Sequence
  Dyad patterns over-represented in STAR elements
  misc_feature (4)..(19): "N" stands for any nucleotide
cgcnnnnnnnnnnnnnnnnacc

SEQ ID NO: 981 - DNA, 24 bp, Artificial Sequence
  Dyad patterns over-represented in STAR elements
  misc_feature (4)..(21): "N" stands for any nucleotide
cacnnnnnnnnnnnnnnnnnncag

SEQ ID NO: 982 - DNA, 14 bp, Artificial Sequence
  Dyad patterns over-represented in STAR elements
  misc_feature (4)..(11): "N" stands for any nucleotide
ggcnnnnnnnngcc

SEQ ID NO: 983 - DNA, 21 bp, Artificial Sequence
  Dyad patterns over-represented in STAR elements
  misc_feature (4)..(18): "N" stands for any nucleotide
gggnnnnnnnnnnnnnnngga

SEQ ID NO: 984 - DNA, 22 bp, Artificial Sequence
  Dyad patterns over-represented in STAR elements
  misc_feature (4)..(19): "N" stands for any nucleotide
ccgnnnnnnnnnnnnnnnngcc

SEQ ID NO: 985 - DNA, 26 bp, Artificial Sequence
  Dyad patterns over-represented in STAR elements
  misc_feature (4)..(23): "N" stands for any nucleotide
ccgnnnnnnnnnnnnnnnnnnnnacc

SEQ ID NO: 986 - DNA, 13 bp, Artificial Sequence
  Dyad patterns over-represented in STAR elements
  misc_feature (4)..(10): "N" stands for any nucleotide
cgannnnnnnccc

SEQ ID NO: 987 - DNA, 12 bp, Artificial Sequence
  Dyad patterns over-represented in STAR elements
  misc_feature (4)..(9): "N" stands for any nucleotide
ccgnnnnnnctc

SEQ ID NO: 988 - DNA, 16 bp, Artificial Sequence
  Dyad patterns over-represented in STAR elements
  misc_feature (4)..(13): "N" stands for any nucleotide
cggnnnnnnnnnnctc

SEQ ID NO: 989 - DNA, 22 bp, Artificial Sequence
  Dyad patterns over-represented in STAR elements
  misc_feature (4)..(19): "N" stands for any nucleotide
cagnnnnnnnnnnnnnnnncgc

SEQ ID NO: 990 - DNA, 9 bp, Artificial Sequence
  Dyad patterns over-represented in STAR elements
  misc_feature (4)..(6): "N" stands for any nucleotide
ccannnagg

SEQ ID NO: 991 - DNA, 24 bp, Artificial Sequence
  Dyad patterns over-represented in STAR elements
  misc_feature (4)..(21): "N" stands for any nucleotide
gccnnnnnnnnnnnnnnnnnngcc

SEQ ID NO: 992 - DNA, 24 bp, Artificial Sequence
  Dyad patterns over-represented in STAR elements
  misc_feature (4)..(21): "N" stands for any nucleotide
cgcnnnnnnnnnnnnnnnnnngga

SEQ ID NO: 993 - DNA, 26 bp, Artificial Sequence
  Dyad patterns over-represented in STAR elements
  misc_feature (4)..(23): "N" stands for any nucleotide
ccgnnnnnnnnnnnnnnnnnnnnggc

SEQ ID NO: 994 - DNA, 16 bp, Artificial Sequence
  Dyad patterns over-represented in STAR elements
  misc_feature (4)..(13): "N" stands for any nucleotide
acannnnnnnnnngcg

SEQ ID NO: 995 - DNA, 11 bp, Artificial Sequence
  Dyad patterns over-represented in STAR elements
  misc_feature (4)..(8): "N" stands for any nucleotide
cggnnnnnccc

SEQ ID NO: 996 - DNA, 13 bp, Artificial Sequence
  Dyad patterns over-represented in STAR elements
  misc_feature (4)..(10): "N" stands for any nucleotide
cccnnnnnnntcc

SEQ ID NO: 997 - DNA, 16 bp, Artificial Sequence
  Dyad patterns over-represented in STAR elements
  misc_feature (4)..(13): "N" stands for any nucleotide
acgnnnnnnnnnncgc

SEQ ID NO: 998 - DNA, 9 bp, Artificial Sequence
  Dyad patterns over-represented in STAR elements
  misc_feature (4)..(6): "N" stands for any nucleotide
cccnnntcc

SEQ ID NO: 999 - DNA, 14 bp, Artificial Sequence
  Dyad patterns over-represented in STAR elements
  misc_feature (4)..(11): "N" stands for any nucleotide
ccgnnnnnnnncgg

SEQ ID NO: 1000 - DNA, 21 bp, Artificial Sequence
  Dyad patterns over-represented in STAR elements
  misc_feature (4)..(18): "N" stands for any nucleotide
ccannnnnnnnnnnnnnncgg

SEQ ID NO: 1001 - DNA, 12 bp, Artificial Sequence
  Dyad patterns over-represented in STAR elements
  misc_feature (4)..(9): "N" stands for any nucleotide
ccgnnnnnnccg

SEQ ID NO: 1002 - DNA, 9 bp, Artificial Sequence
  Dyad patterns over-represented in STAR elements
  misc_feature (4)..(6): "N" stands for any nucleotide
cagnnngcg

SEQ ID NO: 1003 - DNA, 7 bp, Artificial Sequence
  Dyad patterns over-represented in STAR elements
  misc_feature (4)..(4): "N" stands for any nucleotide
gagnccc

SEQ ID NO: 1004 - DNA, 24 bp, Artificial Sequence
  Dyad patterns over-represented in STAR elements
  misc_feature (4)..(21): "N" stands for any nucleotide
ccgnnnnnnnnnnnnnnnnnntgc

SEQ ID NO: 1005 - DNA, 13 bp, Artificial Sequence
  Dyad patterns over-represented in STAR elements
  misc_feature (4)..(10): "N" stands for any nucleotide
cccnnnnnnncca

SEQ ID NO: 1006 - DNA, 9 bp, Artificial Sequence
  Dyad patterns over-represented in STAR elements
  misc_feature (4)..(6): "N" stands for any nucleotide
cggnnncca

SEQ ID NO: 1007 - DNA, 7 bp, Artificial Sequence
  Dyad patterns over-represented in STAR elements
  misc_feature (4)..(4): "N" stands for any nucleotide
acgnccc

SEQ ID NO: 1008 - DNA, 19 bp, Artificial Sequence
  Dyad patterns over-represented in STAR elements
  misc_feature (4)..(16): "N" stands for any nucleotide
cggnnnnnnnnnnnnntga

SEQ ID NO: 1009 - DNA, 12 bp, Artificial Sequence
  Dyad patterns over-represented in STAR elements
  misc_feature (4)..(9): "N" stands for any nucleotide
ctcnnnnnnggc

SEQ ID NO: 1010 - DNA, 8 bp, Artificial Sequence
  Dyad patterns over-represented in STAR elements
  misc_feature (4)..(5): "N" stands for any nucleotide
gcgnngac

SEQ ID NO: 1011 - DNA, 17 bp, Artificial Sequence
  Dyad patterns over-represented in STAR elements
  misc_feature (4)..(14): "N" stands for any nucleotide
gggnnnnnnnnnnnacc

SEQ ID NO: 1012 - DNA, 10 bp, Artificial Sequence
  Dyad patterns over-represented in STAR elements
  misc_feature (4)..(7): "N" stands for any nucleotide
cgcnnnngga

SEQ ID NO: 1013 - DNA, 17 bp, Artificial Sequence
  Dyad patterns over-represented in STAR elements
  misc_feature (4)..(14): "N" stands for any nucleotide
cccnnnnnnnnnnnccg

SEQ ID NO: 1014 - DNA, 25 bp, Artificial Sequence
  Dyad patterns over-represented in STAR elements
  misc_feature (4)..(22): "N" stands for any nucleotide
ccgnnnnnnnnnnnnnnnnnnngca

SEQ ID NO: 1015 - DNA, 6 bp, Artificial Sequence
  Dyad patterns over-represented in STAR elements
gcggca

SEQ ID NO: 1016 - DNA, 13 bp, Artificial Sequence
  Dyad patterns over-represented in STAR elements
  misc_feature (4)..(10): "N" stands for any nucleotide
agannnnnnnccc

SEQ ID NO: 1017 - DNA, 8 bp, Artificial Sequence
  Dyad patterns over-represented in STAR elements
  misc_feature (4)..(5): "N" stands for any nucleotide
cggnncca

SEQ ID NO: 1018 - DNA, 12 bp, Artificial Sequence
  Dyad patterns over-represented in STAR elements
  misc_feature (4)..(9): "N" stands for any nucleotide
cccnnnnnnccc

SEQ ID NO: 1019 - DNA, 10 bp, Artificial Sequence
  Dyad patterns over-represented in STAR elements
  misc_feature (4)..(7): "N" stands for any nucleotide
accnnnngcg

SEQ ID NO: 1020 - DNA, 21 bp, Artificial Sequence
  Dyad patterns over-represented in STAR elements
  misc_feature (4)..(18): "N" stands for any nucleotide
cctnnnnnnnnnnnnnnncgc

SEQ ID NO: 1021 - DNA, 15 bp, Artificial Sequence
  Dyad patterns over-represented in STAR elements
  misc_feature (4)..(12): "N" stands for any nucleotide
agcnnnnnnnnngtc

SEQ ID NO: 1022 - DNA, 24 bp, Artificial Sequence
  Dyad patterns over-represented in STAR elements
  misc_feature (4)..(21): "N" stands for any nucleotide
cccnnnnnnnnnnnnnnnnnnctc

SEQ ID NO: 1023 - DNA, 24 bp, Artificial Sequence
  Dyad patterns over-represented in STAR elements
  misc_feature (4)..(21): "N" stands for any nucleotide
cgcnnnnnnnnnnnnnnnnnncga

SEQ ID NO: 1024 - DNA, 21 bp, Artificial Sequence
  Dyad patterns over-represented in STAR elements
  misc_feature (4)..(18): "N" stands for any nucleotide
cccnnnnnnnnnnnnnnngcc

SEQ ID NO: 1025 - DNA, 17 bp, Artificial Sequence
  Dyad patterns over-represented in STAR elements
  misc_feature (4)..(14): "N" stands for any nucleotide
accnnnnnnnnnnnggc

SEQ ID NO: 1026 - DNA, 21 bp, Artificial Sequence
  Dyad patterns over-represented in STAR elements
  misc_feature (4)..(18): "N" stands for any nucleotide
aggnnnnnnnnnnnnnnncgc

SEQ ID NO: 1027 - DNA, 6 bp, Artificial Sequence
  Dyad patterns over-represented in STAR elements
gcgcca

SEQ ID NO: 1028 - DNA, 15 bp, Artificial Sequence
  Dyad patterns over-represented in STAR elements
  misc_feature (4)..(12): "N" stands for any nucleotide
gcgnnnnnnnnnagc

SEQ ID NO: 1029 - DNA, 24 bp, Artificial Sequence
  Dyad patterns over-represented in STAR elements
  misc_feature (4)..(21): "N" stands for any nucleotide
gggnnnnnnnnnnnnnnnnnngca

SEQ ID NO: 1030 - DNA, 23 bp, Artificial Sequence
  Dyad patterns over-represented in STAR elements
  misc_feature (4)..(20): "N" stands for any nucleotide
cccnnnnnnnnnnnnnnnnncag

SEQ ID NO: 1031 - DNA, 14 bp, Artificial Sequence
  Dyad patterns over-represented in STAR elements
  misc_feature (4)..(11): "N" stands for any nucleotide
ccannnnnnnncgg

SEQ ID NO: 1032 - DNA, 16 bp, Artificial Sequence
  Dyad patterns over-represented in STAR elements
  misc_feature (4)..(13): "N" stands for any nucleotide
ccgnnnnnnnnnnggc

SEQ ID NO: 1033 - DNA, 6 bp, Artificial Sequence
  Dyad patterns over-represented in STAR elements
gcagcc

SEQ ID NO: 1034 - DNA, 8 bp, Artificial Sequence
  Dyad patterns over-represented in STAR elements
  misc_feature (4)..(5): "N" stands for any nucleotide
cagnncgc

SEQ ID NO: 1035 - DNA, 14 bp, Artificial Sequence
  Dyad patterns over-represented in STAR elements
  misc_feature (4)..(11): "N" stands for any nucleotide
cgcnnnnnnnnggc

SEQ ID NO: 1036 - DNA, 23 bp, Artificial Sequence
  Dyad patterns over-represented in STAR elements
  misc_feature (4)..(20): "N" stands for any nucleotide
ctgnnnnnnnnnnnnnnnnnggc

SEQ ID NO: 1037 - DNA, 20 bp, Artificial Sequence
  Dyad patterns over-represented in STAR elements
  misc_feature (4)..(17): "N" stands for any nucleotide
gggnnnnnnnnnnnnnnacc

SEQ ID NO: 1038 - DNA, 7 bp, Artificial Sequence
  Dyad patterns over-represented in STAR elements
  misc_feature (4)..(4): "N" stands for any nucleotide
ccgntgc

SEQ ID NO: 1039 - DNA, 14 bp, Artificial Sequence
  Dyad patterns over-represented in STAR elements
  misc_feature (4)..(11): "N" stands for any nucleotide
cagnnnnnnnncgc

SEQ ID NO: 1040 - DNA, 17 bp, Artificial Sequence
  Dyad patterns over-represented in STAR elements
  misc_feature (4)..(14): "N" stands for any nucleotide
aagnnnnnnnnnnncgc

SEQ ID NO: 1041 - DNA, 12 bp, Artificial Sequence
  Dyad patterns over-represented in STAR elements
  misc_feature (4)..(9): "N" stands for any nucleotide
ccgnnnnnntcc

SEQ ID NO: 1042 - DNA, 24 bp, Artificial Sequence
  Dyad patterns over-represented in STAR elements
  misc_feature (4)..(21): "N" stands for any nucleotide
ccannnnnnnnnnnnnnnnnnccc

SEQ ID NO: 1043 - DNA, 6 bp, Artificial Sequence
  Dyad patterns over-represented in STAR elements
ccaccc

SEQ ID NO: 1044 - DNA, 12 bp, Artificial Sequence
  Dyad patterns over-represented in STAR elements
  misc_feature (4)..(9): "N" stands for any nucleotide
gagnnnnnnccc

SEQ ID NO: 1045 - DNA, 26 bp, Artificial Sequence
  Dyad patterns over-represented in STAR elements
  misc_feature (4)..(23): "N" stands for any nucleotide
agcnnnnnnnnnnnnnnnnnnnnggc

SEQ ID NO: 1046 - DNA, 6 bp, Artificial Sequence
  Dyad patterns over-represented in STAR elements
cagcgc

SEQ ID NO: 1047 - DNA, 18 bp, Artificial Sequence
  Dyad patterns over-represented in STAR elements
  misc_feature (4)..(15): "N" stands for any nucleotide
ccgnnnnnnnnnnnnctc

SEQ ID NO: 1048 - DNA, 21 bp, Artificial Sequence
  Dyad patterns over-represented in STAR elements
  misc_feature (4)..(18): "N" stands for any nucleotide
cgcnnnnnnnnnnnnnnnacg

SEQ ID NO: 1049 - DNA, 23 bp, Artificial Sequence
  Dyad patterns over-represented in STAR elements
  misc_feature (4)..(20): "N" stands for any nucleotide
ggcnnnnnnnnnnnnnnnnncga

SEQ ID NO: 1050 - DNA, 22 bp, Artificial Sequence
  Dyad patterns over-represented in STAR elements
  misc_feature (4)..(19): "N" stands for any nucleotide
ccgnnnnnnnnnnnnnnnnaag

SEQ ID NO: 1051 - DNA, 20 bp, Artificial Sequence
  Dyad patterns over-represented in STAR elements
  misc_feature (4)..(17): "N" stands for any nucleotide
cgcnnnnnnnnnnnnnntcc

SEQ ID NO: 1052 - DNA, 13 bp, Artificial Sequence
  Dyad patterns over-represented in STAR elements
  misc_feature (4)..(10): "N" stands for any nucleotide
aggnnnnnnncgc

SEQ ID NO: 1053 - DNA, 13 bp, Artificial Sequence
  Dyad patterns over-represented in STAR elements
  misc_feature (4)..(10): "N" stands for any nucleotide
cggnnnnnnnccc

SEQ ID NO: 1054 - DNA, 10 bp, Artificial Sequence
  Dyad patterns over-represented in STAR elements
  misc_feature (4)..(7): "N" stands for any nucleotide
cgcnnnngcc

SEQ ID NO: 1055 - DNA, 12 bp, Artificial Sequence
  Dyad patterns over-represented in STAR elements
  misc_feature (4)..(9): "N" stands for any nucleotide
cgannnnnnccc

SEQ ID NO: 1056 - DNA, 25 bp, Artificial Sequence
  Dyad patterns over-represented in STAR elements
  misc_feature (4)..(22): "N" stands for any nucleotide
cccnnnnnnnnnnnnnnnnnnngga

SEQ ID NO: 1057 - DNA, 22 bp, Artificial Sequence
  Dyad patterns over-represented in STAR elements
  misc_feature (4)..(19): "N" stands for any nucleotide
cccnnnnnnnnnnnnnnnngcg

SEQ ID NO: 1058 - DNA, 13 bp, Artificial Sequence
  Dyad patterns over-represented in STAR elements
  misc_feature (4)..(10): "N" stands for any nucleotide
ccannnnnnncgc

SEQ ID NO: 1059 - DNA, 12 bp, Artificial Sequence
  Dyad patterns over-represented in STAR elements
  misc_feature (4)..(9): "N" stands for any nucleotide
cccnnnnnngcc

SEQ ID NO: 1060 - DNA, 20 bp, Artificial Sequence
  Dyad patterns over-represented in STAR elements
  misc_feature (4)..(17): "N" stands for any nucleotide
gccnnnnnnnnnnnnnntcc

SEQ ID NO: 1061 - DNA, 20 bp, Artificial Sequence
  Dyad patterns over-represented in STAR elements
  misc_feature (4)..(17): "N" stands for any nucleotide
aggnnnnnnnnnnnnnngcc

SEQ ID NO: 1062 - DNA, 17 bp, Artificial Sequence
  Dyad patterns over-represented in STAR elements
  misc_feature (4)..(14): "N" stands for any nucleotide
cgcnnnnnnnnnnngcc

SEQ ID NO: 1063 - DNA, 6 bp, Artificial Sequence
  Dyad patterns over-represented in STAR elements
tccgca

SEQ ID NO: 1064 - DNA, 14 bp, Artificial Sequence
  Dyad patterns over-represented in STAR elements
  misc_feature (4)..(11): "N" stands for any nucleotide
gcgnnnnnnnnccc

SEQ ID NO: 1065 - DNA, 17 bp, Artificial Sequence
  Dyad patterns over-represented in STAR elements
  misc_feature (4)..(14): "N" stands for any nucleotide
ccannnnnnnnnnngcg

SEQ ID NO: 1066 - DNA, 10 bp, Artificial Sequence
  Dyad patterns over-represented in STAR elements
  misc_feature (4)..(7): "N" stands for any nucleotide
cacnnnnggg

SEQ ID NO: 1067 - DNA, 13 bp, Artificial Sequence
  Dyad patterns over-represented in STAR elements
  misc_feature (4)..(10): "N" stands for any nucleotide
cggnnnnnnntcc

SEQ ID NO: 1068 - DNA, 11 bp, Artificial Sequence
  Dyad patterns over-represented in STAR elements
  misc_feature (4)..(8): "N" stands for any nucleotide
gcgnnnnngcc

SEQ ID NO: 1069 - DNA, 18 bp, Artificial Sequence
  Dyad patterns over-represented in STAR elements
  misc_feature (4)..(15): "N" stands for any nucleotide
acgnnnnnnnnnnnncag

SEQ ID NO: 1070 - DNA, 25 bp, Artificial Sequence
  Dyad patterns over-represented in STAR elements
  misc_feature (4)..(22): "N" stands for any nucleotide
ccgnnnnnnnnnnnnnnnnnnncgc

SEQ ID NO: 1071 - DNA, 14 bp, Artificial Sequence
  Dyad patterns over-represented in STAR elements
  misc_feature (4)..(11): "N" stands for any nucleotide
cggnnnnnnnntgc

SEQ ID NO: 1072 - DNA, 7 bp, Artificial Sequence
  Dyad patterns over-represented in STAR elements
  misc_feature (4)..(4): "N" stands for any nucleotide
cccngag

SEQ ID NO: 1073 - DNA, 25 bp, Artificial Sequence
  Dyad patterns over-represented in STAR elements
  misc_feature (4)..(22): "N" stands for any nucleotide
gcgnnnnnnnnnnnnnnnnnnntga

SEQ ID NO: 1074 - DNA, 21 bp, Artificial Sequence
  Dyad patterns over-represented in STAR elements
  misc_feature (4)..(18): "N" stands for any nucleotide
ggcnnnnnnnnnnnnnnngcc

SEQ ID NO: 1075 - DNA, 13 bp, Artificial Sequence
  Dyad patterns over-represented in STAR elements
  misc_feature (4)..(10): "N" stands for any nucleotide
ccgnnnnnnnccc

SEQ ID NO: 1076 - DNA, 25 bp, Artificial Sequence
  Dyad patterns over-represented in STAR elements
  misc_feature (4)..(22): "N" stands for any nucleotide
acannnnnnnnnnnnnnnnnnnccc

SEQ ID NO: 1077 - DNA, 22 bp, Artificial Sequence
  Dyad patterns over-represented in STAR elements
  misc_feature (4)..(19): "N" stands for any nucleotide
accnnnnnnnnnnnnnnnnggg

SEQ ID NO: 1078 - DNA, 7 bp, Artificial Sequence
  Dyad patterns over-represented in STAR elements
  misc_feature (4)..(4): "N" stands for any nucleotide
aganggc

SEQ ID NO: 1079 - DNA, 23 bp, Artificial Sequence
  Dyad patterns over-represented in STAR elements
  misc_feature (4)..(20): "N" stands for any nucleotide
gggnnnnnnnnnnnnnnnnntga

SEQ ID NO: 1080 - DNA, 11 bp, Artificial Sequence
  Dyad patterns over-represented in STAR elements
  misc_feature (4)..(8): "N" stands for any nucleotide
cagnnnnnggg

SEQ ID NO: 1081 - DNA, 19 bp, Artificial Sequence
  Dyad patterns over-represented in STAR elements
  misc_feature (4)..(16): "N" stands for any nucleotide
gccnnnnnnnnnnnnncgc

SEQ ID NO: 1082 - DNA, 13 bp, Artificial Sequence
  Dyad patterns over-represented in STAR elements
  misc_feature (4)..(10): "N" stands for any nucleotide
gcgnnnnnnngga

SEQ ID NO: 1083 - DNA, 20 bp, Artificial Sequence
  Dyad patterns over-represented in STAR elements
  misc_feature (4)..(17): "N" stands for any nucleotide
cagnnnnnnnnnnnnnncca

SEQ ID NO: 1084 - DNA, 10 bp, Artificial Sequence
  Dyad patterns over-represented in STAR elements
  misc_feature (4)..(7): "N" stands for any nucleotide
ccgnnnngtc

SEQ ID NO: 1085 - DNA, 19 bp, Artificial Sequence
  Dyad patterns over-represented in STAR elements
  misc_feature (4)..(16): "N" stands for any nucleotide
cccnnnnnnnnnnnnncgc

SEQ ID NO: 1086 - DNA, 20 bp, Artificial Sequence
  Dyad patterns over-represented in STAR elements
  misc_feature (4)..(17): "N" stands for any nucleotide
gcgnnnnnnnnnnnnnnacc

SEQ ID NO: 1087 - DNA, 26 bp, Artificial Sequence
  Dyad patterns over-represented in STAR elements
  misc_feature (4)..(23): "N" stands for any nucleotide
cagnnnnnnnnnnnnnnnnnnnnggg

SEQ ID NO: 1088 - DNA, 10 bp, Artificial Sequence
  Dyad patterns over-represented in STAR elements
  misc_feature (4)..(7): "N" stands for any nucleotide
ccgnnnnccc

SEQ ID NO: 1089 - DNA, 11 bp, Artificial Sequence
  Dyad patterns over-represented in STAR elements
  misc_feature (4)..(8): "N" stands for any nucleotide
cgcnnnnnggc

SEQ ID NO: 1090 - DNA, 12 bp, Artificial Sequence
  Dyad patterns over-represented in STAR elements
  misc_feature (4)..(9): "N" stands for any nucleotide
cctnnnnnnggc

SEQ ID NO: 1091 - DNA, 9 bp, Artificial Sequence
  Dyad patterns over-represented in STAR elements
  misc_feature (4)..(6): "N" stands for any nucleotide
aggnnnggc

SEQ ID NO: 1092 - DNA, 17 bp, Artificial Sequence
  Dyad patterns over-represented in STAR elements
  misc_feature (4)..(14): "N" stands for any nucleotide
cggnnnnnnnnnnncgc

SEQ ID NO: 1093 - DNA, 24 bp, Artificial Sequence
  Dyad patterns over-represented in STAR elements
  misc_feature (4)..(21): "N" stands for any nucleotide
ctgnnnnnnnnnnnnnnnnnngga

SEQ ID NO: 1094 - DNA, 23 bp, Artificial Sequence
  Dyad patterns over-represented in STAR elements
  misc_feature (4)..(20): "N" stands for any nucleotide
cacnnnnnnnnnnnnnnnnncca

SEQ ID NO: 1095 - DNA, 9 bp, Artificial Sequence
  Dyad patterns over-represented in STAR elements
  misc_feature (4)..(6): "N" stands for any nucleotide
cggnnngag

SEQ ID NO: 1096 - DNA, 15 bp, Artificial Sequence
  Dyad patterns over-represented in STAR elements
  misc_feature (4)..(12): "N" stands for any nucleotide
cccnnnnnnnnncca

SEQ ID NO: 1097 - DNA, 7 bp, Artificial Sequence
  Dyad patterns over-represented in STAR elements
  misc_feature (4)..(4): "N" stands for any nucleotide
cccnacg

SEQ ID NO: 1098 - DNA, 7 bp, Artificial Sequence
  Dyad patterns over-represented in STAR elements
  misc_feature (4)..(4): "N" stands for any nucleotide
cagngcc

SEQ ID NO: 1099 - DNA, 12 bp, Artificial Sequence
  Dyad patterns over-represented in STAR elements
  misc_feature (4)..(9): "N" stands for any nucleotide
aggnnnnnnccg

SEQ ID NO: 1100 - DNA, 15 bp, Artificial Sequence
  Dyad patterns over-represented in STAR elements
  misc_feature (4)..(12): "N" stands for any nucleotide
agcnnnnnnnnnggg

SEQ ID NO: 1101 - DNA, 13 bp, Artificial Sequence
  Dyad patterns over-represented in STAR elements
  misc_feature (4)..(10): "N" stands for any nucleotide
cccnnnnnnnggc

SEQ ID NO: 1102 - DNA, 19 bp, Artificial Sequence
  Dyad patterns over-represented in STAR elements
  misc_feature (4)..(16): "N" stands for any nucleotide
cctnnnnnnnnnnnnnccc

SEQ ID NO: 1103 - DNA, 25 bp, Artificial Sequence
  Dyad patterns over-represented in STAR elements
  misc_feature (4)..(22): "N" stands for any nucleotide
ccgnnnnnnnnnnnnnnnnnnnttc

SEQ ID NO: 1104 - DNA, 13 bp, Artificial Sequence
  Dyad patterns over-represented in STAR elements
  misc_feature (4)..(10): "N" stands for any nucleotide
cccnnnnnnnccg

SEQ ID NO: 1105 - DNA, 12 bp, Artificial Sequence
  Dyad patterns over-represented in STAR elements
  misc_feature (4)..(9): "N" stands for any nucleotide
cgannnnnnggc

SEQ ID NO: 1106 - DNA, 10 bp, Artificial Sequence
  Dyad patterns over-represented in STAR elements
  misc_feature (4)..(7): "N" stands for any nucleotide
cggnnnnctc

SEQ ID NO: 1107 - DNA, 6 bp, Artificial Sequence
  Dyad patterns over-represented in STAR elements
cggcgc

SEQ ID NO: 1108 - DNA, 19 bp, Artificial Sequence
  Dyad patterns over-represented in STAR elements
  misc_feature (4)..(16): "N" stands for any nucleotide
cctnnnnnnnnnnnnnacg

SEQ ID NO: 1109 - DNA, 12 bp, Artificial Sequence
  Dyad patterns over-represented in STAR elements
  misc_feature (4)..(9): "N" stands for any nucleotide
gggnnnnnncac

SEQ ID NO: 1110 - DNA, 22 bp, Artificial Sequence
  Dyad patterns over-represented in STAR elements
  misc_feature (4)..(19): "N" stands for any nucleotide
cccnnnnnnnnnnnnnnnncgc

SEQ ID NO: 1111 - DNA, 16 bp, Artificial Sequence
  Dyad patterns over-represented in STAR elements
  misc_feature (4)..(13): "N" stands for any nucleotide
cccnnnnnnnnnnctc

SEQ ID NO: 1112 - DNA, 6 bp, Artificial Sequence
  Dyad patterns over-represented in STAR elements
ccccag

SEQ ID NO: 1113 - DNA, 11 bp, Artificial Sequence
  Dyad patterns over-represented in STAR elements
  misc_feature (4)..(8): "N" stands for any nucleotide
gccnnnnnccc

What is claimed is:

1. A cell comprising a first polypeptide expression unit and a second polypeptide expression unit, said first and said second polypeptide expression units each encoding at least one polypeptide of interest, wherein said first and second polypeptide expression units each comprise at least one sequence having the capacity to at least in part block chromatin-associated repression, wherein said sequence having the capacity to at least in part block chromatin-associated repression for the first polypeptide expression unit comprises SEQ ID NO: 7 or a fragment thereof able to, at least in part, block chromatin-associated repression, and wherein said sequence having the capacity to at least in part block chromatin-associated repression for the second polypeptide expression unit is selected from the group consisting of: any one of SEQ ID NO: 1 through SEQ ID NO: 65 and fragments thereof; wherein at least one of said first and said second polypeptide expression units comprises a heterologous promoter.

2. The cell of claim 1, wherein said sequence having the capacity to at least in part block chromatin-associated repression for the second polypeptide expression unit comprises SEQ ID NO:7 or a fragment thereof.

3. The cell of claim 1, wherein said first and second polypeptide expression units each further encode a different selection marker.

4. The cell of claim 1, wherein at least one of said first and second polypeptide expression units comprises a monocistronic gene comprising an open reading frame encoding a polypeptide of interest and wherein said monocistronic gene is under control of a functional promoter.

5. The cell of claim 1, wherein at least one of said first and second polypeptide expression units comprises a bicistronic gene comprising in the following order: (i) an open reading frame encoding a polypeptide of interest, (ii) an Internal Ribosome Entry Site (IRES), and (iii) a selection marker, and wherein said bicistronic gene is under control of a functional promoter.

6. The cell of claim 1, wherein at least one of said first and second polypeptide expression units comprises at least two of said sequences having the capacity to at least in part block chromatin-associated repression, arranged such that said polypeptide expression unit is flanked on both sides by at least one of said sequences having the capacity to at least in part block chromatin-associated repression.

7. The cell of claim 5, wherein said at least two sequences having the capacity to at least in part block chromatin-associated repression are essentially identical.

8. The cell of claim 1, wherein at least one polypeptide of interest comprises an immunoglobulin heavy chain, or an immunoglobulin light chain.

9. The cell of claim 8, wherein at least one polypeptide of interest comprises an immunoglobulin heavy chain and the other polypeptide of interest comprises an immunoglobulin light chain, wherein said heavy and light chain can form a functional antibody.

10. A method for expressing at least two polypeptides of interest in a cell, said method comprising:
providing a cell, said cell comprising a first polypeptide expression unit and a second polypeptide expression unit, said first and second polypeptide expression units each encoding at least one polypeptide of interest, wherein said first and second polypeptide expression units each comprise at least one sequence having the capacity to at least in part block chromatin-associated repression, wherein said sequence having the capacity to at least in part block chromatin-associated repression for the first polypeptide expression unit comprises SEQ ID NO:7 or a fragment thereof able to, at least in part, block chromatin-associated repression, and wherein said sequence having the capacity to at least in part block chromatin-associated repression for the second polypeptide expression unit is selected from the group consisting of: any one of SEQ ID NO: 1 through SEQ ID NO: 65 and fragments thereof; and
culturing said cell under conditions wherein said first and second polypeptide expression units are expressed.

11. The method of claim 10, wherein said sequence having the capacity to at least in part block chromatin-associated repression for the second polypeptide expression unit comprises SEQ ID NO:7 or a fragment thereof.

12. The method of claim 10, wherein said first and second polypeptide expression units each further encode a different selection marker.

13. The method of claim 10, wherein at least one of said first and second polypeptide expression units comprises a monocistronic gene comprising an open reading frame encoding a polypeptide of interest and wherein said monocistronic gene is under control of a functional promoter.

14. The method of claim 10, wherein at least one of said first and second polypeptide expression units comprises a bicistronic gene comprising in the following order: (i) an open reading frame encoding a polypeptide of interest, (ii) an Internal Ribosome Entry Site (IRES), and (iii) a selection marker, and wherein said bicistronic gene is under control of a functional promoter.

15. The method of claim 10, wherein at least one of said first and second polypeptide expression units comprises at least two of said sequences having the capacity to at least in part block chromatin-associated repression, arranged such that said polypeptide expression unit is flanked on both sides by at least one of said sequences having the capacity to at least in part block chromatin-associated repression.

16. The method of claim 10, wherein at least one polypeptide of interest comprises an immunoglobulin heavy chain, or an immunoglobulin light chain.

17. The method of claim 15, wherein at least one polypeptide of interest comprises an immunoglobulin heavy chain and the other polypeptide of interest comprises an immunoglobulin light chain, wherein said heavy and light chain can form a functional antibody.

18. A polypeptide expression unit comprising:
a bicistronic gene comprising in the following order: (i) an open reading frame encoding a polypeptide of interest, (ii) an Internal Ribosome Entry Site (IRES), and (iii) a selection marker, and wherein said bicistronic gene is under control of a functional promoter; and
at least one sequence having the capacity to at least in part block chromatin-associated repression, wherein said sequence having the capacity to at least in part block chromatin-associated repression comprises SEQ ID NO:7 or a fragment thereof able to at least in part block chromatin-associated repression.

19. The polypeptide expression unit of claim 18, further comprising a further sequence having the capacity to at least in part block chromatin-associated repression, wherein said further sequence is selected from the group consisting of any one of SEQ ID NO:1 through SEQ ID NO: 65 and fragments thereof, and wherein said further sequence is arranged with said polypeptide expression unit such that said polypeptide expression unit, on one side, comprises SEQ ID NO:7 or a fragment thereof, and on another side comprises said further sequence having the capacity to at least in part block chromatin-associated repression.

20. The polypeptide expression unit of claim 18, wherein said polypeptide of interest comprises an immunoglobulin heavy chain or an immunoglobulin light chain.

21. A method for obtaining a host cell expressing two polypeptides of interest, the method comprising:
   a) providing host cells comprising:
      (i) a first polypeptide expression unit comprising a bicistronic gene comprising a promoter functionally linked to a sequence encoding a first polypeptide of interest and a first selectable marker gene, and
      (ii) a second polypeptide expression unit comprising a bicistronic gene comprising a promoter functionally linked to a sequence encoding a second polypeptide of interest and a second selectable marker gene,
   wherein said second selectable marker gene is different from said first selectable marker gene, and wherein said first polypeptide expression unit, or said second polypeptide expression unit, or each of said first and said second polypeptide expression units comprise at least one sequence having the capacity to at least in part block chromatin-associated repression, wherein said sequence having the capacity to at least in part block chromatin-associated repression comprises SEQ ID NO:7 or a fragment thereof able to, at least in part, block chromatin-associated repression; and
   b) selecting a host cell by selecting for expression of said first and second selectable marker genes.

22. A method for expressing two polypeptides of interest, the method comprising:
   a) providing host cells comprising:
      (i) a first polypeptide expression unit comprising a bicistronic gene comprising a promoter functionally linked to a sequence encoding a first polypeptide of interest and a first selectable marker gene, and
      (ii) a second polypeptide expression unit comprising a bicistronic gene comprising a promoter functionally linked to a sequence encoding a second polypeptide of interest and a second selectable marker gene,
   wherein said second selectable marker gene is different from said first selectable marker gene, and wherein said first polypeptide expression unit, or said second polypeptide expression unit, or each of said first and said second polypeptide expression units comprise at least one sequence having the capacity to at least in part block chromatin-associated repression, wherein said sequence having the capacity to at least in part block chromatin-associated repression comprises SEQ ID NO:7 or a fragment thereof able to, at least in part, block chromatin-associated repression;
   b) selecting a host cell by selecting for expression of said first and second selectable marker genes; and
   c) culturing a selected host cell to express said first and second polypeptides.

23. The method of claim 22, wherein each of said first and said second expression units comprise at least one sequence having the capacity to at least in part block chromatin-associated repression, said sequence having the capacity to at least in part block chromatin-associated repression comprising SEQ ID NO:7 or a fragment thereof.

24. The method of claim 22, wherein the two polypeptides of interest form part of a multimeric protein.

25. The method of claim 22, wherein at least one of said two polypeptides of interest comprises an immunoglobulin heavy chain, or an immunoglobulin light chain.

26. The method of claim 25, wherein at least one of said two polypeptides of interest comprises an immunoglobulin heavy chain and the other polypeptide of interest comprises an immunoglobulin light chain, wherein said heavy and light chain can form a functional antibody.

27. A set of two polypeptide expression units, said set comprising:
   (i) a first polypeptide expression unit comprising a bicistronic gene comprising a promoter functionally linked to a sequence encoding a first polypeptide of interest and a first selectable marker gene, and
   (ii) a second polypeptide expression unit comprising a bicistronic gene comprising a promoter functionally linked to a sequence encoding a second polypeptide of interest and a second selectable marker gene,
   wherein said second selectable marker gene is different from said first selectable marker gene, and wherein said first polypeptide expression unit, or said second polypeptide expression unit, or both said first and said second polypeptide expression units comprise at least one sequence having the capacity to at least in part block chromatin-associated repression, wherein said sequence having the capacity to at least in part block chromatin-associated repression comprises SEQ ID NO:7 or a fragment thereof able to, at least in part, block chromatin-associated repression.

28. A polypeptide expression unit comprising:
   a bicistronic gene comprising in the following order: (i) an open reading frame encoding a polypeptide of interest, (ii) an Internal Ribosome Entry Site, and (iii) a selection marker, wherein said bicistronic gene is under control of a functional promoter; and
   nucleic acid sequence means for at least in part blocking chromatin-associated repression, wherein nucleic acid sequence means comprises a fragment of SEQ ID NO: 7 wherein said fragment is able to at least partially block chromatin-associated repression.

29. A cell comprising:
   a first polypeptide expression unit and a second polypeptide expression unit, each of said first and second polypeptide expression units encoding at least one polypeptide of interest, and wherein said first and second polypeptide expression units each comprise at least one nucleic acid sequence means for at least in part blocking chromatin-associated repression, wherein said nucleic acid sequence means for the first polypeptide expression unit comprises a fragment of SEQ ID NO:7, wherein said fragment is able to at least partially block chromatin-associated repression, and wherein said nucleic acid sequence for the second polypeptide expression unit comprises a fragment of any one of SEQ ID NO:1 through SEQ ID NO: 65, wherein said fragment is able to at least partially block chromatin-associated repression.

30. A cell comprising a first polypeptide expression unit and a second polypeptide expression unit, said first and said second polypeptide expression units each encoding at least one polypeptide of interest, wherein said first and second polypeptide expression units each comprise at least one sequence having the capacity to at least in part block chromatin-associated repression, wherein said sequence having the capacity to at least in part block chromatin-associated repression for the first polypeptide expression unit comprises SEQ ID NO: 7, and wherein said sequence having the capacity to at least in part block chromatin-associated repression for the second polypeptide expression unit is selected from the group consisting of any one of SEQ ID NO: 1 through SEQ ID NO: 65; wherein at least one of said first and said second polypeptide expression units comprises a heterologous promoter.

31. The cell of claim 30, wherein said sequence having the capacity to at least in part block chromatin-associated repression for the second polypeptide expression unit comprises SEQ ID NO:7.

32. The cell of claim 30, wherein said first and second polypeptide expression units each further encode a different selection marker.

33. The cell of claim 30, wherein at least one of said first and second polypeptide expression units comprises a monocistronic gene comprising an open reading frame encoding a polypeptide of interest and wherein said monocistronic gene is under control of a functional promoter.

34. The cell of claim 30, wherein at least one of said first and second polypeptide expression units comprises a bicistronic gene comprising in the following order: (i) an open reading frame encoding a polypeptide of interest, (ii) an Internal Ribosome Entry Site (IRES), and (iii) a selection marker, and wherein said bicistronic gene is under control of a functional promoter.

35. The cell of claim 30, wherein at least one of said first and second polypeptide expression units comprises at least two of said sequences having the capacity to at least in part block chromatin-associated repression, arranged such that said polypeptide expression unit is flanked on both sides by at least one of said sequences having the capacity to at least in part block chromatin-associated repression.

36. The cell of claim 30, wherein at least one polypeptide of interest comprises an immunoglobulin heavy chain, or an immunoglobulin light chain.

37. The cell of claim 36, wherein at least one polypeptide of interest comprises an immunoglobulin heavy chain and the other polypeptide of interest comprises an immunoglobulin light chain, wherein said heavy and light chain can form a functional antibody.

38. A method for expressing at least two polypeptides of interest in a cell, said method comprising:
    providing a cell, said cell comprising a first polypeptide expression unit and a second polypeptide expression unit, said first and second polypeptide expression units each encoding at least one polypeptide of interest, wherein said first and second polypeptide expression units each comprise at least one sequence having the capacity to at least in part block chromatin-associated repression, wherein said sequence having the capacity to at least in part block chromatin-associated repression for the first polypeptide expression unit comprises SEQ ID NO:7, and wherein said sequence having the capacity to at least in part block chromatin-associated repression for the second polypeptide expression unit is selected from the group consisting of: any one of SEQ ID NO: 1 through SEQ ID NO: 65; and
    culturing said cell under conditions wherein said first and second polypeptide expression units are expressed.

39. The method of claim 38, wherein said sequence having the capacity to at least in part block chromatin-associated repression for the second polypeptide expression unit comprises SEQ ID NO:7.

40. The method of claim 38, wherein said first and second polypeptide expression units each further encode a different selection marker.

41. The method of claim 38, wherein at least one of said first and second polypeptide expression units comprises a monocistronic gene comprising an open reading frame encoding a polypeptide of interest and wherein said monocistronic gene is under control of a functional promoter.

42. The method of claim 38, wherein at least one of said first and second polypeptide expression units comprises a bicistronic gene comprising in the following order: (i) an open reading frame encoding a polypeptide of interest, (ii) an Internal Ribosome Entry Site (IRES), and (iii) a selection marker, and wherein said bicistronic gene is under control of a functional promoter.

43. The method of claim 38, wherein at least one of said first and second polypeptide expression units comprises at least two of said sequences having the capacity to at least in part block chromatin-associated repression, arranged such that said polypeptide expression unit is flanked on both sides by at least one of said sequences having the capacity to at least in part block chromatin-associated repression.

44. The method of claim 38, wherein at least one polypeptide of interest comprises an immunoglobulin heavy chain, or an immunoglobulin light chain.

45. The method of claim 44, wherein at least one polypeptide of interest comprises an immunoglobulin heavy chain and the other polypeptide of interest comprises an immunoglobulin light chain, wherein said heavy and light chain can form a functional antibody.

46. A polypeptide expression unit comprising:
    a bicistronic gene comprising in the following order: (i) an open reading frame encoding a polypeptide of interest, (ii) an Internal Ribosome Entry Site (IRES), and (iii) a selection marker, and wherein said bicistronic gene is under control of a functional promoter; and
    at least one sequence having the capacity to at least in part block chromatin-associated repression, wherein said sequence having the capacity to at least in part block chromatin-associated repression comprises SEQ ID NO:7.

47. The polypeptide expression unit of claim 46, further comprising a further sequence having the capacity to at least in part block chromatin-associated repression, wherein said further sequence is selected from the group consisting of any one of SEQ ID NO:1 through SEQ ID NO: 65, and wherein said further sequence is arranged with said polypeptide expression unit such that said polypeptide expression unit, on one side, comprises SEQ ID NO:7, and on another side comprises said further sequence having the capacity to at least in part block chromatin-associated repression.

48. The polypeptide expression unit of claim 46, wherein said polypeptide of interest comprises an immunoglobulin heavy chain or an immunoglobulin light chain.

49. A method for obtaining a host cell expressing two polypeptides of interest, the method comprising:
    a) providing host cells comprising:
        (i) a first polypeptide expression unit comprising a bicistronic gene comprising a promoter functionally linked to a sequence encoding a first polypeptide of interest and a first selectable marker gene, and
        (ii) a second polypeptide expression unit comprising a bicistronic gene comprising a promoter functionally linked to a sequence encoding a second polypeptide of interest and a second selectable marker gene,
    wherein said second selectable marker gene is different from said first selectable marker gene, and wherein said first polypeptide expression unit, or said second polypeptide expression unit, or each of said first and said second polypeptide expression units comprise at least one sequence having the capacity to at least in part block chromatin-associated repression, wherein said sequence having the capacity to at least in part block chromatin-associated repression comprises SEQ ID NO:7; and b) selecting a host cell by selecting for expression of said first and second selectable marker genes.

50. A method for expressing two polypeptides of interest, the method comprising:
   a) providing host cells comprising:
      (i) a first polypeptide expression unit comprising a bicistronic gene comprising a promoter functionally linked to a sequence encoding a first polypeptide of interest and a first selectable marker gene, and
      (ii) a second polypeptide expression unit comprising a bicistronic gene comprising a promoter functionally linked to a sequence encoding a second polypeptide of interest and a second selectable marker gene,
   wherein said second selectable marker gene is different from said first selectable marker gene, and wherein said first polypeptide expression unit, or said second polypeptide expression unit, or each of said first and said second polypeptide expression units comprise at least one sequence having the capacity to at least in part block chromatin-associated repression, wherein said sequence having the capacity to at least in part block chromatin-associated repression comprises SEQ ID NO:7;
   b) selecting a host cell by selecting for expression of said first and second selectable marker genes; and
   c) culturing a selected host cell to express said first and second polypeptides.

51. The method of claim 50, wherein each of said first and said second expression units comprise at least one sequence having the capacity to at least in part block chromatin-associated repression, said sequence having the capacity to at least in part block chromatin-associated repression comprising SEQ ID NO:7.

52. The method of claim 50, wherein the two polypeptides of interest form part of a multimeric protein.

53. The method of claim 50, wherein at least one of said two polypeptides of interest comprises an immunoglobulin heavy chain, or an immunoglobulin light chain.

54. The method of claim 53, wherein at least one of said two polypeptides of interest comprises an immunoglobulin heavy chain and the other polypeptide of interest comprises an immunoglobulin light chain, wherein said heavy and light chain can form a functional antibody.

55. A set of two polypeptide expression units, said set comprising:
   (i) a first polypeptide expression unit comprising a bicistronic gene comprising a promoter functionally linked to a sequence encoding a first polypeptide of interest and a first selectable marker gene, and
   (ii) a second polypeptide expression unit comprising a bicistronic gene comprising a promoter functionally linked to a sequence encoding a second polypeptide of interest and a second selectable marker gene,
   wherein said second selectable marker gene is different from said first selectable marker gene, and wherein said first polypeptide expression unit, or said second polypeptide expression unit, or both said first and said second polypeptide expression units comprise at least one sequence having the capacity to at least in part block chromatin-associated repression, wherein said sequence having the capacity to at least in part block chromatin-associated repression comprises SEQ ID NO:7.

* * * * *